United States Patent 11,396,665 (CRISPR-CAS SYSTEM FOR A FILAMENTOUS FUNGAL HOST CELL) - sequence listing, part 14

SEQ ID NO: 1 - DNA, 34023457 bp, Aspergillus niger CBS 513.88 (residues 27,644,072-29,770,538 of 34,023,457)
  misc_feature (44288)..(44288): n is a, c, g, or t
  misc_feature (155272)..(155272): n is a, c, g, or t
  misc_feature (204666)..(204666): n is a, c, g, or t
  misc_feature (204692)..(204692): n is a, c, g, or t
  misc_feature (204710)..(204710): n is a, c, g, or t
  misc_feature (204969)..(204969): n is a, c, g, or t
  misc_feature (272073)..(272073): n is a, c, g, or t
  misc_feature (353582)..(353582): n is a, c, g, or t
  misc_feature (353617)..(353617): n is a, c, g, or t
  misc_feature (353648)..(353648): n is a, c, g, or t
  misc_feature (492428)..(492428): n is a, c, g, or t
  misc_feature (536235)..(536235): n is a, c, g, or t
  misc_feature (545939)..(545939): n is a, c, g, or t
  misc_feature (576552)..(576552): n is a, c, g, or t
  misc_feature (897515)..(897515): n is a, c, g, or t
  misc_feature (1474394)..(1474394): n is a, c, g, or t
  misc_feature (1474413)..(1474413): n is a, c, g, or t
  misc_feature (2211250)..(2211250): n is a, c, g, or t
  misc_feature (2211257)..(2211257): n is a, c, g, or t
  misc_feature (2211262)..(2211262): n is a, c, g, or t
  misc_feature (2211273)..(2211273): n is a, c, g, or t
  misc_feature (2211340)..(2211340): n is a, c, g, or t
  misc_feature (2211351)..(2211351): n is a, c, g, or t
  misc_feature (2211362)..(2211362): n is a, c, g, or t
  misc_feature (2211366)..(2211366): n is a, c, g, or t
  misc_feature (2240253)..(2240253): n is a, c, g, or t
  misc_feature (3211430)..(3211430): n is a, c, g, or t
  misc_feature (3236949)..(3236949): n is a, c, g, or t
  misc_feature (3236971)..(3236971): n is a, c, g, or t
  misc_feature (3236974)..(3236974): n is a, c, g, or t
  misc_feature (3279330)..(3279330): n is a, c, g, or t
  misc_feature (3281470)..(3281470): n is a, c, g, or t
  misc_feature (3392636)..(3392636): n is a, c, g, or t
  misc_feature (3732237)..(3732237): n is a, c, g, or t
  misc_feature (5041781)..(5041781): n is a, c, g, or t
  misc_feature (5341902)..(5341902): n is a, c, g, or t
  misc_feature (5341936)..(5341936): n is a, c, g, or t
  misc_feature (5342071)..(5342071): n is a, c, g, or t
  misc_feature (5351253)..(5351253): n is a, c, g, or t
  misc_feature (5353905)..(5353905): n is a, c, g, or t
  misc_feature (5353957)..(5353957): n is a, c, g, or t
  misc_feature (5353992)..(5353992): n is a, c, g, or t
  misc_feature (5358550)..(5358550): n is a, c, g, or t
  misc_feature (5362032)..(5362032): n is a, c, g, or t
  misc_feature (5365780)..(5365780): n is a, c, g, or t
  misc_feature (5365950)..(5365950): n is a, c, g, or t
  misc_feature (5761519)..(5761519): n is a, c, g, or t
  misc_feature (5985404)..(5985404): n is a, c, g, or t
  misc_feature (6012602)..(6012602): n is a, c, g, or t
  misc_feature (6014761)..(6014761): n is a, c, g, or t
  misc_feature (6406250)..(6406250): n is a, c, g, or t
  misc_feature (6442329)..(6442329): n is a, c, g, or t
  misc_feature (6565980)..(6565980): n is a, c, g, or t
  misc_feature (6565998)..(6565998): n is a, c, g, or t
  misc_feature (6644910)..(6644910): n is a, c, g, or t
  misc_feature (6645360)..(6645360): n is a, c, g, or t
  misc_feature (6648073)..(6648073): n is a, c, g, or t
  misc_feature (6660134)..(6660134): n is a, c, g, or t
  misc_feature (6673420)..(6673420): n is a, c, g, or t
  misc_feature (6693683)..(6693683): n is a, c, g, or t
  misc_feature (7245096)..(7245096): n is a, c, g, or t
  misc_feature (7245209)..(7245209): n is a, c, g, or t
  misc_feature (7390252)..(7390252): n is a, c, g, or t
  misc_feature (7564123)..(7564123): n is a, c, g, or t
  misc_feature (7791179)..(7791179): n is a, c, g, or t
  misc_feature (7791329)..(7791329): n is a, c, g, or t
  misc_feature (7928208)..(7928208): n is a, c, g, or t
  misc_feature (8076596)..(8076596): n is a, c, g, or t
  misc_feature (8157973)..(8157973): n is a, c, g, or t
  misc_feature (8740123)..(8740123): n is a, c, g, or t
  misc_feature (8740163)..(8740163): n is a, c, g, or t
  misc_feature (8772652)..(8772652): n is a, c, g, or t
  misc_feature (9507873)..(9507873): n is a, c, g, or t
  misc_feature (11055132)..(11055132): n is a, c, g, or t
  misc_feature (11071349)..(11071349): n is a, c, g, or t
  misc_feature (11121800)..(11121800): n is a, c, g, or t
  misc_feature (11404221)..(11404221): n is a, c, g, or t
  misc_feature (11568789)..(11568789): n is a, c, g, or t
  misc_feature (11863540)..(11863540): n is a, c, g, or t
  misc_feature (11877402)..(11877402): n is a, c, g, or t
  misc_feature (11911481)..(11911481): n is a, c, g, or t
  misc_feature (11912752)..(11912752): n is a, c, g, or t
  misc_feature (11968951)..(11968951): n is a, c, g, or t
  misc_feature (12367370)..(12367370): n is a, c, g, or t
  misc_feature (12372065)..(12372065): n is a, c, g, or t
  misc_feature (12372965)..(12372965): n is a, c, g, or t
  misc_feature (12375656)..(12375656): n is a, c, g, or t
  misc_feature (12375703)..(12375703): n is a, c, g, or t
  misc_feature (12377954)..(12377954): n is a, c, g, or t
  misc_feature (12626090)..(12626090): n is a, c, g, or t
  misc_feature (13041044)..(13041044): n is a, c, g, or t
  misc_feature (13104777)..(13104777): n is a, c, g, or t
  misc_feature (13149455)..(13149455): n is a, c, g, or t
  misc_feature (13149505)..(13149505): n is a, c, g, or t
  misc_feature (13149655)..(13149655): n is a, c, g, or t
  misc_feature (13149817)..(13149817): n is a, c, g, or t
  misc_feature (13150087)..(13150087): n is a, c, g, or t
  misc_feature (13150168)..(13150168): n is a, c, g, or t
  misc_feature (13150579)..(13150579): n is a, c, g, or t
  misc_feature (13150589)..(13150589): n is a, c, g, or t
  misc_feature (13243052)..(13243052): n is a, c, g, or t
  misc_feature (13504900)..(13504900): n is a, c, g, or t
  misc_feature (14125556)..(14125556): n is a, c, g, or t
  misc_feature (14538858)..(14538858): n is a, c, g, or t
  misc_feature (14580213)..(14580213): n is a, c, g, or t
  misc_feature (14617561)..(14617561): n is a, c, g, or t
  misc_feature (15135229)..(15135229): n is a, c, g, or t
  misc_feature (15673700)..(15673700): n is a, c, g, or t
  misc_feature (15680214)..(15680214): n is a, c, g, or t
  misc_feature (15680253)..(15680253): n is a, c, g, or t
  misc_feature (15706397)..(15706397): n is a, c, g, or t
  misc_feature (15925206)..(15925206): n is a, c, g, or t
  misc_feature (16029110)..(16029110): n is a, c, g, or t
  misc_feature (16071114)..(16071114): n is a, c, g, or t
  misc_feature (16136527)..(16136527): n is a, c, g, or t
  misc_feature (16136560)..(16136560): n is a, c, g, or t
  misc_feature (16181131)..(16181131): n is a, c, g, or t
  misc_feature (16181211)..(16181211): n is a, c, g, or t
  misc_feature (16181216)..(16181216): n is a, c, g, or t
  misc_feature (16181254)..(16181254): n is a, c, g, or t
  misc_feature (16181526)..(16181526): n is a, c, g, or t
  misc_feature (17068554)..(17068554): n is a, c, g, or t
  misc_feature (17068589)..(17068589): n is a, c, g, or t
  misc_feature (17068613)..(17068613): n is a, c, g, or t
  misc_feature (17068629)..(17068629): n is a, c, g, or t
  misc_feature (17068675)..(17068675): n is a, c, g, or t
  misc_feature (17590013)..(17590013): n is a, c, g, or t
  misc_feature (17974213)..(17974213): n is a, c, g, or t
  misc_feature (17978856)..(17978856): n is a, c, g, or t
  misc_feature (18643930)..(18643930): n is a, c, g, or t
  misc_feature (19027505)..(19027505): n is a, c, g, or t
  misc_feature (19147250)..(19147250): n is a, c, g, or t
  misc_feature (19179931)..(19179931): n is a, c, g, or t
  misc_feature (19349554)..(19349554): n is a, c, g, or t
  misc_feature (19655816)..(19655816): n is a, c, g, or t
  misc_feature (20110664)..(20110731): n is a, c, g, or t
  misc_feature (20110737)..(20110737): n is a, c, g, or t
  misc_feature (20110739)..(20110739): n is a, c, g, or t
  misc_feature (20110808)..(20110808): n is a, c, g, or t
  misc_feature (20299836)..(20299836): n is a, c, g, or t
  misc_feature (20320503)..(20320503): n is a, c, g, or t
  misc_feature (20320539)..(20320539): n is a, c, g, or t
  misc_feature (20339923)..(20339923): n is a, c, g, or t
  misc_feature (20588046)..(20588046): n is a, c, g, or t
  misc_feature (20948568)..(20948568): n is a, c, g, or t
  misc_feature (20948647)..(20948647): n is a, c, g, or t
  misc_feature (21058040)..(21058040): n is a, c, g, or t
  misc_feature (22258653)..(22258654): n is a, c, g, or t
  misc_feature (22415976)..(22415976): n is a, c, g, or t
  misc_feature (22640314)..(22640314): n is a, c, g, or t
  misc_feature (23378009)..(23378009): n is a, c, g, or t
  misc_feature (23433651)..(23433651): n is a, c, g, or t
  misc_feature (23436512)..(23436512): n is a, c, g, or t
  misc_feature (23437393)..(23437393): n is a, c, g, or t
  misc_feature (23437633)..(23437633): n is a, c, g, or t
  misc_feature (23449914)..(23449914): n is a, c, g, or t
  misc_feature (23462439)..(23462439): n is a, c, g, or t
  misc_feature (23463544)..(23463544): n is a, c, g, or t
  misc_feature (23465687)..(23465687): n is a, c, g, or t
  misc_feature (23465828)..(23465828): n is a, c, g, or t
  misc_feature (23465841)..(23465841): n is a, c, g, or t
  misc_feature (23469523)..(23469523): n is a, c, g, or t
  misc_feature (23504436)..(23504436): n is a, c, g, or t
  misc_feature (23504463)..(23504463): n is a, c, g, or t
  misc_feature (23867695)..(23867695): n is a, c, g, or t
  misc_feature (23867705)..(23867705): n is a, c, g, or t
  misc_feature (23867737)..(23867737): n is a, c, g, or t
  misc_feature (23867760)..(23867760): n is a, c, g, or t
  misc_feature (23867855)..(23867855): n is a, c, g, or t
  misc_feature (24835306)..(24835306): n is a, c, g, or t
  misc_feature (25027966)..(25027966): n is a, c, g, or t
  misc_feature (25330363)..(25330363): n is a, c, g, or t
  misc_feature (25817596)..(25817596): n is a, c, g, or t
  misc_feature (26235308)..(26235308): n is a, c, g, or t
  misc_feature (26235623)..(26235623): n is a, c, g, or t
  misc_feature (26296953)..(26296953): n is a, c, g, or t
  misc_feature (26315317)..(26315317): n is a, c, g, or t
  misc_feature (26315331)..(26315331): n is a, c, g, or t
  misc_feature (26603609)..(26603609): n is a, c, g, or t
  misc_feature (26608927)..(26608927): n is a, c, g, or t
  misc_feature (27099287)..(27099287): n is a, c, g, or t
  misc_feature (27101717)..(27101717): n is a, c, g, or t
  misc_feature (27129691)..(27129691): n is a, c, g, or t
  misc_feature (27130274)..(27130274): n is a, c, g, or t
  misc_feature (27147663)..(27147663): n is a, c, g, or t
  misc_feature (27172978)..(27172978): n is a, c, g, or t
  misc_feature (27172997)..(27172997): n is a, c, g, or t
  misc_feature (27173006)..(27173006): n is a, c, g, or t
  misc_feature (27173639)..(27173639): n is a, c, g, or t
  misc_feature (27491488)..(27491488): n is a, c, g, or t
  misc_feature (27527882)..(27527882): n is a, c, g, or t
  misc_feature (27595100)..(27595100): n is a, c, g, or t
  misc_feature (27620372)..(27620372): n is a, c, g, or t
  misc_feature (29653195)..(29653195): n is a, c, g, or t
  misc_feature (29653379)..(29653379): n is a, c, g, or t
  misc_feature (29681499)..(29681499): n is a, c, g, or t
  misc_feature (29708368)..(29708368): n is a, c, g, or t
  misc_feature (29723415)..(29723415): n is a, c, g, or t
  misc_feature (29761631)..(29761632): n is a, c, g, or t
  misc_feature (29761708)..(29761708): n is a, c, g, or t
  misc_feature (30422934)..(30422934): n is a, c, g, or t
  misc_feature (30914321)..(30914321): n is a, c, g, or t
  misc_feature (31202086)..(31202086): n is a, c, g, or t
  misc_feature (31452777)..(31452777): n is a, c, g, or t
  misc_feature (31487666)..(31487666): n is a, c, g, or t
  misc_feature (31487741)..(31487741): n is a, c, g, or t
  misc_feature (31533626)..(31533626): n is a, c, g, or t
  misc_feature (31543898)..(31543898): n is a, c, g, or t
  misc_feature (31546005)..(31546005): n is a, c, g, or t
  misc_feature (31548816)..(31548816): n is a, c, g, or t
  misc_feature (31787390)..(31787390): n is a, c, g, or t
  misc_feature (32267261)..(32267261): n is a, c, g, or t
  misc_feature (32709153)..(32709153): n is a, c, g, or t
  misc_feature (32871693)..(32871693): n is a, c, g, or t
  misc_feature (33981746)..(33981746): n is a, c, g, or t
  misc_feature (33981774)..(33981774): n is a, c, g, or t
  misc_feature (33981781)..(33981781): n is a, c, g, or t
ttctccatccgcacgcgagccaccatggcgaccagcccggcgccgagcatcgtctccattaattcctgcttacatcgcctgagcaatacggccagcgctgtgccatgactcacgaaaattccgtcggtttccatctcccttaacacgtcaacaacaacacctccaccactcttccttccgccctcacagcgcatgccacccgcatttcattcccgagctcaagcttagaagaattacgcacgcacgcacgcacgcgaccacccacaatggcacaccccgaaaaccaaaccgacgacctcacctctaaggaggtctctcccttccaaaccagtcgagagctatcagcatccctcctcgcgcgatgccgatcccttctctccgagataagcgacttccagaccctgctggtggaaacccaacgcaatcctcagatcgtggaggtgcggtcgctgaaatcaaatgtgctttcagagctgcgcacgttggagaagctcgacgcgcaggtccagaagctgccggacccgacgaagagcgatggggttgatgcagattcaggtgacgatgatgaaccaacggctaggagactggttcatacgttgaagtcctccaatttgccgttttatgaggccgtttgggccattgcgaagaatacttgccgcgggttggtggcttttgggaagaggttctattggggggatgataatggtgtttcggaggagaaaaggtccgggaaggataagaagaagagtgtgtttgtggatattattgctgatgatggggaggagtgggttaaggtgtctacggttgcagagtcgaggttgttgtttgagatggcggagaaggggtgggaggctggttctgagtctgaggaggagggggaggctaggacggttctacggaatcatgatggggattgtgatgaggtggacgatgaggatgaggatgaaattgagctggtgaagttggctaaagatttgaggaacgcggccaatgctacgagagtcaggtataaacatcctcggctgcggtttgtggcgcctaggatccacgagggaagctgtgcggagattgacgatcttttgaagattattagaagctatgggatcagagtggattgcggtgaaaaggcatatgctgtggctggtacacaggcacaggagggcttatcgcatctccttcctaagccgttcaaacactttacttccactattaatgtggactgcacattgatgcttgctgcggtctccgatctctcgcattacaaacatatcacggaatctccgcagcatcataaggccatcaatcgacagatcgctgttgagcatgagcgacctttgttgcccactgagctgtggcccgcaatggatgcctatgaactagtgtgtgtggaggaggctgccacacggatgaaagagatcgtcaatattatcggcactgacactgaaaggctgcgcatggaaatcctgctcggcgagccccccttcgatacctatagccgagaggacctcatcaagaaataccaggagttgtccgattatgaaataccggcgcactggaaaattccggtcaagacggtcgaagcgaagtcggtgattgcgtctgcgagagatactgcaaagctgccgcctgtctatcagaaggtggctgagaacctctccgatatcaactatggtgtgtttctgtacggatgggctgcgggactggcgacgatctccagcaatcggaccgtggtcaaggagattgagtccattatcgagaagcacagagatggggatgacggcttggagggacctcttatctgggtgtgtgatactgccaggagcttgataggcaaagaaaagggtcggaagaactagaccaacaactagttcggagacgctaatgatagatcggacgtcaaacagaatctttaccccgttcttgcattagaggtggatcagcagcacatgcggggcgtgatggcttgctacttttcagaagatctggaagggtcctctggaagccagaaaactgtctctttgtcggcagacgcaatcatgttgtacctcggattgtattcaacgatggcagtccgtcctcgatgtgatagtctagtcattggctgcaatagaccgtttggctctggaggagattgttgtagatcccacactagcatgtcggaataatctcccgaaccaccaaccacgtatcgcccgtcgggtgagaagcacgcatctccctgaccgagaggcttcccggttgttgataccggtgcagcccttccgggtgatccggccttgcccaccaagaacgccttaacggtgccctcgaaggcatcgagaatgaaatgcccatggtagtctgtcccgacaagcaagtgcttgccatcattggagaattccaggcgagtccaccccctgcctcgtgtagaaggcgtataccgttcctcgtacggcgcaaggtcgaaactggagaacggagctttgtcgtagttgcggaggtcgtaaagaaggactgacgcggttgactgggatgcaatggcaatgacagaagcagaagggtcgaaggccacgaggtatggagtcgcaagtttcaatttcccttgcgcgtttctagagccgagatcccagagtgcaacggtatcgtctttggagcatgagatgaaggagtcactgccaggagatagagctaaacaggtgactttgtcggtgtgaccctggaagtagcgaatgtagccttcattgtgaaggtccaacaagcgcaatgaatctaggccggtcagaacagagggtaaggatggcggcgcgctggagcagacataccgtcaaccttggtgctcgcatggaggacctgacgactgtggtgggtgaacctggctagatgggcgccgtacttcttgctgggaaccgactttgtagacttgccctccttgatatcgaaaacctggatagtctcatcatcacccgatgccaccaagtaatctccttggtcatcaaagtccagcgacgtcacataattagaggtatcctgctttgggcctcggaatgcctatggttggagaaacagacgattagatggctggcccggtccataagggccattgaactaaccttggtaggacggaaactacgaatgatgtccgagaccttctggcattgtagaattggctgctggggctgtggttgcgccgtcggttgcggttgaccttcagccatacttcttgacttgactagaacagataatgataaagtgcgactgcggggaacaggatgcaagttctcaggatgtccacgaccttaaagcttacaagccagacagatccgtttgattttacccggctattttctccgagattcctcgacctgcaaggatttccacccaaagtgacccgagtagagaagtaataaaggtcgtcactgggggaagccaacgcgccttgacgatggattttgacgcgtttgaccgacttccgcgggggggattgttgttccgctccgacgcttaccatcggccgtgaaggagccgattggccgaggtcggaggctctggattgaaaagtgcggatcccgtggccaatgaccgtccaattatcggctgcggataccaatccgagcggcgttggactgtcggagaaggcttgaatggcggagggaatctcacggcatgaacacctcagctctgacaccgtttttgagtttctgacaagtgcatcgctcaccctactcttccactgcgccgtcactgagtctgtcatcttcccctcccggggcactcagcatctcttcacgcaacagccaggtcgtcctgatttcaccagcgcccttgtcggcctcgctcttgcccttccgcgcgcagactcggttcaactcccctccgttagcggagacgaatctgaacagatacaatgtccacaacaacagggtacgtggtgctgcctccaaacccgtcagattacggtcgcattaacgcataaattcgttccctacagagcattcatcgcaggaggtgttgcagcatgcggagcagtgacggttactcatagctttgagacggtgaagattcggtacagtcttcctcccttatttggagtgtcgcggattactcctcgccagccgtgtcgccggattctaatttgtatctatacgaaagtctgcaactgcagggcgaactgcaggccaagcaggacgctgccaagaaataccggggtgtcttgcacggtgtgaaggttattctacagaatgagggtccccgcggtcttttccggggtataggctcggcagtacgttcgcctatcagcgtccaagatacttgtatagctaacagccactgcagtatatctaccaagtcctgctcaacggttgccgtctgggtttctacgaaccgctgcgccagggtctggcaaccacaatataccaggatgctcaagttcaatcgctgggtattaacgtcctcgctggtgctgcttctggtatcattggagctgccgcgggttcgccctttttcctcgtcaagacccgtctgcaatcgttctcccctttccttcccgtcggcacccagcacaactacaagaactcgtttgatggactgcggaagatccacacgtcggagggagtttctggcttataccgtggagttggcgcggcaatggtacgaactggtttcggtagttccgttcagctgccgacctacttcttcgcgaagcgccgcttgatgaagcacctgggcatggaagatggtccaggcctgcacctggccagtagcacggcatctggctttgtcgtctgctgtgttatgcacccacccggtatgttgtacacttatggcataaccgaattccgctaacttgttgttcagacaccatcatgtctagaatgtacaaccaaaccggcaatctctacaagggcgtgttcgattgcttgttcaagaccatcaagacggagggtgtgttggctatctacaaggggtactttgctcatcttgcgcgtattctgcctcacacggtaagtggtgttttaacattctccccgcccataggcgatttactaacccggctgtagatcttgaccttgagtttggccgagcagaccaacaaaatcatgcgcggactggaggatcggttcctgtctgactcgttgaaggagaacttgtagtcaccgtagtataatagcgacattggcatacccccctgaaactttgcgacacatatagagaagtttcgggacatttttttctggttctgcattattgagcagcagcatggccagcatcgcgtgatgtgtatgtacatagggcgttctgtcttgggtcgtcatgctgtgttcctagatttggcatcccatttggataaaatagtttgaatagatttcgtgttggccagagtcagcatgtgcctggtgtcggagtatgatatatgatgcaatcatcaagcagccttgggaataccatgtcgcatcatggatggcgggagagagacgcggacgcgcgagaacctcaccggacacagtatggggaaatgaacagttgatgagtgtcaaactagacgagccgcccagggcaggatgtggatacaatggagcttataaaagtaattggggaagctactacgcgaactagccagtggtcccatgttaatcgagctaagtatgatggcggcagtgcggcattgcttttcttccgccggatgcatgagctcgggatgcaacgcgtcgtgtttggtgccgatggaacagtccatacacgatccggtgtagagaaagtaaacaacgagacttagtcaacgatttccctgaaaagggacgacagcaatccggctctttattttgcagtcaaaggaaacgaattttcttgtctactgtacggagctttgtacataaacctaacctaaccaaggatgatcatgttgcagcagggctccgacgcgtcgcagctgtaacgtcatcaccacactgcaaagacacaacaccgatcaggctgtaagcccccactcgggtcagctcagccagcaggatctagaatcaagtgggaaaggagaagcaaggatcctctattattggggtccaaacatccgtaaatccgtggtgggtgcgggacagctgccaatgtgcatgaaggaagccgacgcgacgcgttcagcacagactctcttggccgtcggagcaacccaactcggggtcggtgatccaaaaatttctgttcagctcggattaagccgagtggagattgcggatgagctcggcttattgatgatgtcgtaaagagtacctaagcagctgcaggaactggtaagcatgtaaggtacggtatgagtgggctaggagatggacacgaagacaagtatcaaacaactggcattatttggtaggaaggactatcagttcttataaaatatatactgggtagggaatagagacatagattgaacatattgacaggatcgatcgaggggttcagagatgggagttcgatcagataagatagtagctggttacgagacgcgactagtcactgactactaaggcaggcatcgacatgctccgtacctgctctccaggcacccgcttctctaggaatgtggagaggaccattatggaaacctgctgcaaggtcttgcagctaatgatacggtaatgatggatcagtggagatcgcaacaccggatgagaacccagccggtggtgtgatagcgccgtgggaagtcattgtggatggaggctgagacgtgatggacgcgccgaacatcaacaacccgcccggatcaatagttgttcccgccagccaccggggcaaaagtcgcgccaagtcacgtgcgacgtgactcgcccgtcgcgctaaggatcacgtcctcgtctgccggcgagtatttcttgtcgtctcgccctccctcgctgcagctctttttcttcacatcccaccaccagctcagtctataggagtgtttctgtgtctgtgtgatcaattcctcttctacttttatctctttcactcacacacacccaacacaatgtctgtacaactcactccctccaagcaggtatgtgatgtcacgtctctcgcctcccactttcgacgcgtaattaaaggcagataagctaacacgcgttgcttccataggctgcttcctccctcgagaacctcaagatgagcgactcgcctgtcaagaagctcaatttcggtggcaaggagaacgcgcctgccgccgttgacgtgactgccgacaagcccgtcgagaagcccgtcgaagcccccaaggttgcgcccggtatcaaggagatggaggccagcgagcctctgcttcaggaaaatccccaccgtttcgtccttttccccatcaagtaccatgaggtgagtgacacgtccgttacgcgtcacgcgtaaagtggaattttgcgcttcccgccccgcaacaattggcatgtgcgctaacgccgcattctcgcaccctacagatctggcagatgtacaagaaggccgaggcctctttctggaccgccgaggaaattgatctgtccaaggatttgcacgactggcacaaccgcctgaacgacgacgagcgctacttcatctcccacgttctcgcgttcttcgctgcctccgatggcattgtcaacgagaaccttgtcgagcgcttcagcggcgaggtccaggttcccgaggctcgttgcttctacggattccagatcatgatggagaacatccactccgagacctactctctcctgattgatacctacatcaaggagcccaagcagcgcacctacctcttcgacgctattgatactagtatgtacctccaaccggggttgtgattggtcaatggatgctaaccgctgcagtcccctgcattgccaagaaggccgattgggccattaagtggatccaggacagggagtcgaccttcgctcagcgtctcgttgctttcgctgccgttgagggtatcttcttctccggttccttcgcttccatcttctggctcaagaagcgtggtctcatgcctggtctcaccttctccaacgagctcatctctcgtgacgagggtctgcacaccgacttcgcttgcctgctgttctcccacctgaacaaccgccccagcaaacaggttgttgaagacatcatcgtcgaggccgtcggcattgagcaggagttcctgactgacgctctgcccgttgctctgctgggcatgaactccaagctgatgtgtcagtacatcgagtttgtcgcggaccgcctgctggtggccctcggcaacaagaagtactacaacgccaccaaccccttcgacttcatggagtcgatctcgctggcgggtaagaccaacttcttcgagaagcgggtaggtgactaccagaaggctggtgtcatggccagcacgaagaaggaagaggaggtcaagaccaacagcaacggcctcagcttcgatgaagacttctaaacaccgaaaaaatgatgccactatacccggttgttggcaccagccacgatatgtttgattctgggtgtttacgaggatatttgattatacgcatgggattggcgttcattggatgggattgattcttttcctttttcttataatgttaatgcttgactcttgtatttagagaaatgtacattggatattttctatattgactatttctgataatccgtagatcacctaggatacttcgtacttataccattcaaatgtcctaacttcaagaaaacatgtgaatgcaagcgattaaatagatacggatatctcccagctatgatcatgaacatgaatcctcaccaccaaacctttatataaaataaaaataaatatgcacacctcaagaaacagaaagtaatgaataaatagccagctagagaggaaaaaagaaatagatagataaatcaattaatcacctcttccccttcccccccttcttcttccctttccctcccttcccagcaccaccagcattactactatccccagctaccaccgtctgcccctctccattcccaccagcagcaccagcaggaggagcaagagcatcccccatctccacatccgcaggagcagcagcagcagtaggattactcaatcccaacccctcaacatcagccccggccgccaacttccccaacgaggtgatcaaccggcccacctcggcgcccttgttcgtgcggtatttcaaacagatgcctgatcccgggtgataggttttgagttcgagcgtggcgatgcggggcttgggttcggtgtcttctgttgaggtgggtggttgttgttgctgttgttttgtggatgtggaggtggatgttgtgcgcgggaatgagtattttgttgtgattctctgcagaaaccagtgttagtatcaatttggtagtagatgttttgttgagagactcggggtaagggaatcatgtaccgtgtctgggtaggcttggaggaggagagaggattgttcgaggtaggattgggaggttgggaggtatggcattttggcgggtttagattccctctgagtggggaggtataagatcgaggatcggtttggttgaagagacgagggtgtgagggtggaggaatgtgtggtaggaaggtgggtgtgatctgaagctgtaattatttctggtgttttgcggcgcccgctcggaggtggaagttcagagttggtggttaggtggtggtttagctagcgggcggtgtgtgtgccgcagcccgtttgacagcttgaacaaacctatcggtttacttagtatgctacagcttgacatactactctaataactattaatggtccaattcgatcgttattcgtcagtcgtccctcgtatagttatgcctactgttatcctgtaggctattgtacatacatacacagctaattacatgctcatatacatcaatcatcccatatccaaaactcgtcctaatccaacatcatatacactgtgcatcagctgataggtcgtgcgcatcgcacacacactaaccgctgctttccattcctcgctttcgtcgctcggaaattcgtccctcggcaattatcgcacttcaacacctcgccgtcttccccgtccccgttggacgacgcatagtcgctgctcagcgcgctgcccaggctcatttggcgctcccccggcaccgacagtcgattcggagtgaggagtccgttgccctcggttcgcttgcggctctgcaccgtcatcgcatcgtgcgcgattttgttgtagaacgcgtagctctgctccccttgtagccagagcgggttatccttgtctccgcccttggggaaccaggtggacccggcgccgcgctgcgggctgtccactgcaacaccgttgtgcccattgcgagtggtgtctgcgctggaccgtcgactgtccatggagtttttatatgcggagggcgtcggggaagtcgtatagatggagcgcgaatcgggtcgtgctcccgtcgagactcgtcctgggctggcgtagcccggcagagtgtcacgcagtgacttgtggggagacgggctgcgggtgcgcggcgtacgcatgcccgagcggttgccatgtcgaataacagagttgcgccatgaaatgatgcggtccgacggcgtcgtcttcatcgaatccttgccgatggaggaggcaatactgtggcgcgccgagttggtgcgtcgcaggatgcgtcgcgagatcgtggaatgcgtgtcccagctgtcgtagcgccgtttctgataggcgcagtcttgtcgcaagaccttgatcttcccggcgtagtccgccacgacgaggatatttccatctgggtgtgtcgagcgcgacatgaacgtcggagagtcttgcgcgagcttgctggcggccgacatgcggttcgctcgtccgttctccttgtcggcctgactgacgagcgtcacgggaggcggattgcagatatcatagatgggatcctcggagaatcctaggacttgtttggcgcggctgggcgccatgatggcggccgtcaccagggcggattgcgtatcgaagacctccacagcccgtttgtcggcgtctttctccacgggccccaccggccagacataggtgcggcgatcctcactgccgcagatgatatgtttcccgtcattgctgaatgaggcgcggatctggctgcacgtgttctcgttccctcggtatttggcctcgagcgtgcggtcgcgaaagttgtagagtcgaatgcgggagtcgttgctggtgattagcagtttgacgtcgccgtgggggtcgccatgtggcaacgacatggtgtcaattccggtgattttgctgcccttggcgttgcgaccgcgagccgagcgcacatggatctgtccaaccgccttgaggccatctgtctcgtagatattgcacagtccgttcagactgcccgagatcgaatgtcgtccgtccggcgtgaatgccaccgctgtaatcatgtcggggaccgtggccacgaaggccacgctcttgtccggaatactccagagtcgcagtttcgtatccagcgacccagccaggaagaaccggtcgtcgcgcgggtggaactggatggaggtgacgaaatcgctgtgttggaagcagcacagacactcgggtcggctgacatgccacagccggacggtcttgtccatggaggaggaaagcaggaaattgttctgtcgcccgcattagtgatgctacgcattgcaccgcctatagtcagttttcatggtaccttgctccagctgagatccaggatactgccggtgtggccctcgtacacctggatcggttggggtttgaacacttgcgcgtttagtcgtggcgcatcgtcgtcgctctccggctcactggggctgcgatcctccggcgatgccacgacctgccagacgcgcaccttgcggtcctgcccggcggcagccatgtatttgccatcattggaaaacaccagggcccagatggctttgcccgtatatctctcattctgcgggccggctgtggagactgcgtcatggtccgagacgctggccgagtcgtcggcgccgtccagctcctgagccaggaagacccggttaaacgtcttctccttcttgtagtgtgcgcgcacgcggatgtatttcggcgggggagggaatcgcggtacgaagcctatgggctgagcggcagcgtcgggatccatgcggctggtttcgggttcagagacatcgtcctcgtcgtccgggaactgggccttcttcttgccagggatgattcgactcaggaaggacactcctttcctatgaggcaggcccaccgagttagctatttaggttcctggggcacaaactgcatgggacaagaagcaacgagcgacgggtgacacaatgcggggtcacgccgtcagcctcggggagttggggggaaacattggctgactcggagccgggggaggccagctggcgcttacttcttctccttcgaaggcttcgtatgcagcgcagtctctccgcgagcagagccatggtccaacgaggcgcgtgggtcgctgccgcccagctccgcctcggtggaggctcttcctaacagcttcaacgggatggttttttgggtgttggttcttttaatgatatgctatcgcgacgcacagagtcaatcaacccgctggtgcgattccagagacacacagtgacacggtatgagccttacttgagacaggggatcgatggcgctcgagtcggcgctggactgggcaaacgtcggggaggaggcgagattcttgacggagccgttgctggcagccggaagggcgcgggaatcctttctggcatgctgctggtatccgtttgacgtagcggtcacatcggaggcggaacctgcacaggataatccccccggagcggaggaatagtaagccaacgatgctcacaattgggatttgatcgatcgggtccgatcggagggtgtggaaagaagatgactggccagcgcgaccgggcgagacagcgggaggcagaggaagaagtcatgtagtagtactagtatgagctgaaattgggacgtaccgataggaaaactttgtgaagagcggaggaaactgggattgggagagctggggctgtgatcgccgcgattgaagatggtcggactattggaggcggaggtggacaagtcgtgatgaatgatgctggaagacgaggcgttggtggtgatgatggcgggcacggtcgaggcccgcgatggcccttcttgctcgtcgcgcattccctccgccatggctcgggtgtcgccgggaatggcgcatgggaagtgagtggtggaggtcagacccaggagagacaaagaagatgtggaggagaatgggatctctccagatagaaaatacgagagagaagtagaagagagggaaacggaaaagggaagaagaggaaggaagccagattgcggcggaggacgcggagattgggattaaggatggagatggagatttgagatggagacacactaactcggacaccggttattaatatccgaaatatccaccagggatgacatcaagcagggtctgaagttagttagttaacttcttggtaattagttttagttaattagtagtgtctagccttctttccacctcgtttcaagatggaggagaccaactgacgaaaccctgggtcggatgggagggccggtctgtggttcttttcgcggtctgtgcgagtcgaggaacggagaagaagaagaagaaaaaccgttgtttgcatgcatgcatcatctccaaagcttgacttttctttccaatctgcatctggtggatatggtatgacatatcttgttgtagtactcgggtttgggccatcatggctggattcccccctttccacatggctggcattggtgtaaccactagtacattcttatcatgactgttacttcttggtatatgactataactaactatatatcaatacgaactccatccgacttgagtcagttgttgctgttgtctttctcccccctccggccaagcttaatcgaccgcaggccaatgaatggaaagccgttggtcgcactgctcggctggccttcctgaagtgactgtcttttaaggtctggtcagaaagtatctcggattcctccaccaatcgcttctttttctttatcctcagggtctcctttcttgtcttactttcttggggttgcagtcgcatcgcatgcgtccttcccctccccagagtttattcaacttatacccgaccataacacccgagtggctatgcattattccccatgattcgtgttgttctactcttgatctactagtctcacaacaacccccacgtggttcatgatacaacatacaaagtagaaaagatgggatcagttgcaccaccatcatcgcccatcgatggtggcccacttgctttatgcttctatcgccaactccgactttccccgttcctgtatcgcttgcacctcgatttcctcgtcctcctccttcgcatacgctacctgataaaccgtgtaccacggtcgttggaacagtccatccagtgcctctagcgatcggcccgttgtgtcctgtgcgctgtcagacccccgccgttacgtctctcccttcttccatcgtcatatcggggagttggttcacttactggcatcgcaaagaacacgtacaccagcgacacaaggcagatgcacgcaaaaaatgcaaaggctccccactcctccatcacttctagcaagtcggggcgtcgcgcgcgtgcacccaaacgcgaacagccagtgccccgccatccccatcgacaaggccagcgatcggatccggatgggaaagatctccgatccgatcaggaagggcatcgagaaccatccgatcacccacccaaccccatgcacaaagatggcggcgatcgccgccttcgaggcctgcgtcgcgctggccgcgtgcaggagggtcgtcgtcgacatctctcgggatatcccaagataacaagcgagatataccaacgtcaggatctggagggtgattcccgccataagagaccgccgtcggcctacaaaatccaccactacaagtgagaagatcagcaaggtggtgaatttgaccacggcatagacgcccgtggttagggacaaggtatccccagacgtgcccaggtatcccaagattgtcggtaaatattgcgtgatggcattgcctccggaccattgcgaaaacagatgtgccagcatcactaggcagaaccgacgccggttctccaccgggacaaacgtctccttgaataggtcccattgtgaggtgcccgtggccgcttccctctcctgcaggatctggaattccatgacagcaatttctgcgactacggttgggtggctcgggggcaagtggcggagctttgcaagtaccgctactgcctgagttcgcctgcccacatacagcagccaccggggagattcttcacagatcaggagtcccagtccccagactgctgcagggagcagttggatcaaggtggggaacatccactgcatatctgttccatcgtagtttttggtaatgccatagttgataaagaacccaaaaacgacccctagttgctggcatgcggcaaattgaactgcgaggagcccgcggatggtcttaggggctacctgcaacaaagtcagtctgttcccagtccccattcaagcatcatttaggcacctcggaaatatacatcggtggggtcacagtcaagccgcccaccccgagacccgcgatcagtctcgatgcgtacagtccggacaggtttccattacagaggccctgtcccaagactccagagacatatactagggtcgatagccgcatcgtccaccgccgcccaattcgatcattgaaaggtaaacactacagtagctgttaacccgacatatatctaccttctgagtagatagcttactagcagacagcccaaggtcattccagccgtgaacatggacacaatccaacctttggtattggcatattcgtcgggggattgctggccgagcccgaatttgatccgaaaccgagattgcacgaccaacgatgcgatattcgctgcgaagatcagcaccctgcatgacatatgatcttcactatctaccttcatcgaaccccctactgatgccggagagcgcaaaaatggcaatgttcatcaacaaataccagttaaagaccccccgaggggagtcccggatggcctgtcgggtttccgcaacgagccccatggttgacttcctaccatgacgggccccgtcagtgagcttatatacccaaccgaagccactcagtctggctggttctgcgacaaaatcgcgcagggtcgcggtgtggcggaaaaatatttcatgacccctccagcgacggtttaaagtaaggagctctccctcacggaggccatcgtgcgttggtatgtgctatagccgagtttaccagggtctagacggcactgggctagattgacaggttctgtcggcgcacaccatcgggactccgcattccatgggggtgctttgtgtgactcggacgtgcacgatagggggtataattgttgatatggcatagagttacattgcgggctcgagtccgagttgcattctgcgccagcgaatccagtccaactggaaatcacggccttttacaggcttttgccggtggtcttgttgcgttggatgctggaaaaccctgtcctccctgccgcggatgcaagggttagaagtgcttggtgtagatatggagtgccaaccgggtttgcaaggttacaaagccggataccactatcgaccggtagcagccgatagaagcttctatgcccgggatgtttgatgcttggttttcgcttactgtaacagatgtgttgcatggacatcatctgcccactcgatacctcggctagaataggatgtctagcagatattcctgttatggtggactgtcgataactcaactaacttaaagcatccatatcacttatcatagatgtgcataagcatgtctggcacgttgaaaccccgagatcgaccggtggtctattcttagctgtcggcgcttaacccatgcttccccgtcgtcgatcccccatcgtcaattccccgctacactcaacctctccctctccctcctattcccacattctacggagtactatccctcaatattctcagaatgtccgctccagacaaccaagctaatcctccccctccacccccaccaccatcagaccctcgcaccaaaatatctccattcgtacggaacctccgaaccgccccgccccgttccctcgctgtctcccaaccacctcctccacccaccacagcagccccaacaggcccatactttctctacggcacgttaatggatccatacatgctaagagatatactagccttgaactcagatcaagatatcgatctacgacctgcatatataacaggctacgcttgtaaattgtggggacagtatccggctctagtaccggatgacacttctacctcggtggtcaaaggtgtcgtgtatcatgtgccttctgtggaggatggagtgaagttggcaaattatgagacggggtggtatcgggctgagtcttgtgaggtcgtgtatacggatggggaggagccagggagggagggtggacatttatttgtgtttgtgggagatgagggggagttgagtgagggtgtgtttgatctcagggtctggctagcgaggatggggaggaaggcgggtaagtgaggttggacaggctggaaatggagacaagtcagttatctgtccccgatatgtcaacgagagatatcatagtacctaaaacaatgtcggtcgtggcatctgatgcccagtagtcaaacctgcatttacacgcttcgtcatcctgatacgtaaatgctccagctgaaatctagagaatattgtctcttttgtgaaaataagaagctcaatccagagaatcagtccggtgtccatgtgtctcagggaatattgtactttgactctttccaattatcatacatcagtgctatatctaatcatgttctagtgtattctcttcatatatgtacatatctaactacagcaaatcacaacagcgatttagcaggcgccgccggcgccaacaaaggcaccagatcaggatcacccttctccatggcgcgcttgtacgccggacgctgtccaatacgctccagatagcgcacgatatgaggatactcatccagactgtagggaacaaacagccgcagggtcgtcaaatggaataccgacacgcagtctgctgcagtgaactcctcaccagccaagtatgtgttcttagctaggtgctggtccatctcctcacaggtcgttttcacccgtgactcggacatcttgtaaacagcgtcctcttcggatggggtaccgcgcatccgactgaacagcatgcccatgaaggatggcattgtcgatccttgggcccggtgcagccagaagacgtagtctgcgtacttggggtggtcgggggtcaagactagacggccctttccgtatttagccaggatgtattcgataatggccatggtctcgcccaagacgacgccgttgtcttcaatgatgggggcagtgccggaccagtggagctggcggtactcatctggggccatgagagtgggcggttggcggttgtagcatttgagagtgtagggaatctcgagctcctcgcagagccaggtgattctctcggattgagagaggcggagatgatggactgtgagaccggacatggttgggatttggggggggggggttatgctgctagagttttggacaggtagtgtggccgggatgccgaaggttgggatatccggaaatgggctccatgggtgtatttatctacatgtaacttgggggactctcgttgattcatcggaagccgggtgtttctgcttagtgttaagctccggtcggtttgtctgttgccgaatatccggccggaaacttgaagacaaagtggatccaatcgaatgatcgaggatttatgcataaaccaagatccacttcattatgccgttgcttgatatacctatatggtaagcccggattatcattgattatcgtagcaaccgtgatagataactgtatatgccccatgatcgagtcgtttggaactcaacgtctctatgttccacccggaatgctgtgggtcacttcttcggtctccgtgaggagtgattcggggccagttagccacggcacaacttgagatggctcaatcgttgcacagcacatattcaccgttgcaagctgtcttgcgatcgcacaaatggcggccagtatgctcgtaaaatggtgggaagagttgggcgggcagcgcaggtgccatactctggtggtttgtactttgggcggaatggtgttgaaaatcgatttatttttagaattcacacttgacatctgctggtctgagctattctgatcaatggcataggattgtgggtgacttgtcagatgcgatgggtgcacgagaagcagaggaaggattaagcatcgggcttgacctcaaagccgagcgggtggcgctttagtcatctcggggctgggagccactccgatcaatcaaccctctcttgacaaccaatcgattacagatctgatctgtcagtttagggaatgatgataagaccgaagcccgagaagctgattaaaatcattgtagatgatgctcatgattatgcgaagatggttgtagaagacgcattggtttacatcatgccgtgtccgtctgcgtctttccctaccttatatataccaccgtggaagctctactaccgtccagcgggacatcagttcagcaacagttatttactacttactactagtagatcactcagtgatagtaccaccaagatcacacgcatccactactcaacacatccaccaccatgaacgcggttctcataacaggcgcgaccggcaaacagggaggttctctcattcgaaacctcgtctcccgaaactcttccttggagatcttagccgtcacgcgagactcctcttccgcttcagctcaacggctgaaacagttgtcttccaacatcaaactggtagaaggcaacttggacaacccggcagagatttttcgcaatgcgcgcgcccagacatcgtctccgatttggggtgtctttagtgtccaggtggggattcccagcttttccaatcaccatcacaatgatcaaatactgattgactctactaggtggccatcggcagcaatgtcgacgaggaagcacagggaaagaaattggtcgatgaagcccttaagcaaaaagtgaagtacttcgtctacagctctgtggaccgtggcggggagcgttcctgggacaacccgaccgatgtccctcactttctgaggaagcatcacattgagcatcacctggtggataaggctaaaggaactgaaatggactgggcgatcctgcgccccgtggcattcatggacaacatggtccctggcttcctgggcaaggtctttgcgacagcctggaaaatggcacttaagggcaaatcccttcaggtggtcgctgtcagtgacatcggtcactttggcgcagaagctttccttaaccctgatgagtacaagggccgggcgatctcgttggcgggagatgatttgacgttcgatcaattggcacaggtgttccagcagaggacgggtcagcggatacccatgaccttccagttcgtgtgttccttgctgttaaccgctgtcaaggatatggggtatatgtacaggtggttccatgatgaaggatatcaggttgatattggcgcgctaaagaagaagcatcccggattgaagaactttggggattggctcgagcaggagagtgattttgtcaagcggtagatgatgttgatgcgtgttttgttttgcaggaagacttaatgtttgatgctgtgtgtatgcttaactatgcacgtgttttgagcgacctaatatagtcattgattcactatgatctggttcttataggtacgaaagggctcgattgtgtgtgcgaatgccactatcgtgctttcctttgagaggaacaattcctgacaggaagtaactctcaaaccagaccatatgcattagccacaataatctcctttagactactccacccaggcttgcccatctctttcagtagatcttccgaccgcttcgaaggtctaacgtctaacaagtccgcgtccttatcccgggcaggcagatctgtcggcaactcgcggttaggaaatattcctcgatagatggtagccaaatcgttccagaagaacggccagccatacgcgaacaggcgttcattttggacggtaggattggtcaaagccgcgacatgtagaagtgcgacatcttcaatgcccacacagtaccctcctgcagggtgaattagccggcatcctcgtaatggttggggttacggatatggttcatgcgtaccatctgggacagtggcgttcacgtgctgagaaactgaggcccattcattcttgatgatagctgctggccatagtagtgtggaaggaaagccttggtgttgtggatcgagagaggcaccgtagcacaacgagggtagaactggacaatatgatttagtgtgttggaagaatatcctgtgcacggagagatgtgcataccggtatttgtcacgaacccaggcttgtgctctttcacccattcccagactccttgctcgcccaaggccttgcttgcgctgtatatgtcgaatccccgtctccattcctcaggagaccccgttttggctcgttgtatggcagtttcattccaagtttctgacgtgatcacggtcttgccattcagatcatcgaggctcattgtgttagccgcttggcaggaggaggtgtagacaaagcgcttcacgctgggctcagcggccgcggaggcaagaatattgtaatccaattgtttgatggaattgaatacctcctctggaccatcgtttggaccagcaaaaatggttactacatgtgctactcctgacatgcctataaattgcacggttaagcattagcgtttgaccagtgagatatccgtaggagatgatatggtgtgtacggacctttcatcgcttcgtcaaaagcacccggacgctgtatgtcttggatttggaccagctcaaagctgtcagttccatacttgtgacggaaatgatctccgagccattggtgcctctgcgcattccgtacggttcccctcacacggtacccgcgactaagcagccgatcggccacattggatccaaccaagctattcgctcccgtaaccaggacccatgatccgtgagggatagctgatgtttcggatacagtcattgtagggatgatccttaggggtgattcttttgtaatggtgtaacgatgaccacgtgcatatcagcggcgatcggggaacatctggctgttaaagtagctcagatgccacatagtgcggtgaaaatgggctccacccagtgcttcgagagagagctcattactgcatggtgtggcagtagtgcagctgcgatagctccactggtagccataaacacagacactcatctcatgtctgcctgtcttatggagcccgctttaccgttttcagaggaattgacgagactccgagacgggaagcatatgattgtatccacccacaagcccatcggaggagagagaccggggagactagcgttattggagacattgaatgaacggtgagtttcgggcgatcatttgagttcggtgtccattcgtatccaccaggacaccgctccttctggacgtctaggtaccaccagcatgatctattccaaagttagcttaagcaggttgactcgggagacagtggcgtgagtggatgttgctttcgggaagtgacaatgtgtctcggagattagggttcatgcctgcttgcttcgatcaatttcccagtaaaccgagtaaaaagagctccctgaaagtcgtttctcggaggcatatacaatatgcccttttttgctccacgtagtcatgggttcggcgaagatggcggcgggttatttcagttcatccaaggcacgacgggatagcgcgcacaggccctatatgaagataattcatgtttggtattccaacgagatgtctgttgtgcttattgctattgcttatatagatagtagttgcctgttggtgtgactgcgagggggcaacagggatgagtcaagcggactaagaacccgctaaatacttagtgagttagtgacgagtcgatcgagtagcaaagtgactccgatttgaccccgacttcttccccgcaaagcacctcctcgcccaaatccacctccccaaaaaggctcatccaccatgtccgaaacggtcccggaactacgcttccgatcgggaaatgtcccaacgcgctatttcaaggcatgtcgctggtgccgcaagcaaaaaatgcgttgtgatgcccgcaatcaggtcccttgcgcccggtgtcgcgccgttggccgcgactgcatcctagacccggttgagagtgcaaggcgacaaagtacccggcggtcatccccggctaatcgcccggtgaggtacaagagaatatacctcactttgagcccctacaagatggaacgagactaatatatagtttggaacacaggcgacaacaagcaaggtcgccttggaccgaaccacacgggttcgggagtccttctcctcgagaacaggatttttctacatccaccactgtacaagatgtcccaatcactgcctcgctcgattcactgccagagtctactgctgcagcggatttgagttcacccggaacagctgagcgacatgcaccggagcaccagcagttgagtccgaatgacatgatcgccccagtttccgtgatgcactccatgtctgtcaatttgctcggatcaagcagtgtgagtgatttgatattaaccatcaacaaaacgtcgttaatagctcgcagatcttcatggacaactccagcaaagcagaccctaaaagcgatattatcgcgcgtgggatcatcagtgaagagcgtgcacgggtgatgtatgaccggtagggcaattcctagaaatcggaaatccactggatcattgctaaccgactgtaagcttcatgggtggcagtaagaacttcctggcactgtttgatcccattcgggacaccttcgattcggtccgctctcgctccctcttctgcttttcggtcatcatctacctcgccagtcgggccgtgatggacttgcggagtgacacccatcttcagcgtgttcttcaagacgaagcgcagagactggcggaggatagtttcttcgaacgcccaaccaaagttgaaactgtacaagggatgatcctgctggctgcctattctgagaaaacctggttctcgaccgcactcatcttgcgtaccgccctcgattccgggctcgagaaatctctagatgccttactgtcccaggaagacgtaccgcgcagttctttatccgcttccatggaagaccgtaagttagtgtggcagacaaggacttggttgatcagcttcaccctggaactagacgtggcatctgggacaggccgcaagtcacggatcgatgcagtggacacgatgaaattgcgcaagttcctcgagtatccactatccttaccttgtgatatgcgcacaatctcaatcatagagatccaccagctccgaagtactactatctccccggaagaccgactatttgctgaccaaagtccaggccaatcgcgcatgtccatcgaaaacgccaagacggttgacgagatcgtattggttgagctgcctgcggtcatgacaagactgcagacttggtggaacacatgggatgaaatccatggcagtaagtgctaagatacaaacgaagagcgtcagtcactgaccagtagcatcaacttgtagacaacgcctttcatgctggtgcattccagcgctgtagtttgaagttgatgttgaactacgcccgaatcttcgttctatgtgcctccctagctcgcattcagaaactcccatccggtgctgccgagcccaaccaggagtcaacaggtgacaaggatgtctcacatttgtggcgcgctctcgctacgaccatcatggatcaattggactgcttcatccaagaaagcgcctaccgctgccagctcacgtgggctcctacctacccagccttgacccttgccttcgtcagtaagtagcacgagaccccgaacgtgggagcacgttctatgtcgatggggccagctaacacgaaaagcaactttcgctctccggatcgctcgatggcgtccggacttgatcgaccaggacctcctgcttgaaagggcccaactgatctgcgattttctcaagcagccgccctatccggatatccatcgtactgtgtccatctttgtcaactacggtcgcgcactagtcgctagccaacgggggcatggggaatactgtgcagatgtgataaagccctcggagcagaccaatgggcaattctcattaggtaggggggcatacggagtcccggtggatgtgtcaacatcttcagggatgccatccgaacaggtgaactacccggcagacgcaatgacccctcagccagaaaaggaacgtggtgccgctggggtacccaatgctgaaaggaccgcgcctggcagacagcttcctgctagactgccggggcccatggaagctcctaattggtcgatgtgtaaccccattgccgattcattcggcttgttcgaagaggagcagaacgacatctttgcttcttgccaatgatgccgtcaattcctcaatagaccagtcgtatggcagtgacgggctaccgatgggagagctatgtccttcattcattaggaacgtgtcaatagacgtgtaagctgggtacgccatcgggaattcgacacattcggtgtcaaaccatagactacacgaggcgagcaactaggtatgcttgtcgacgctaaaagtagaaagatagctcgaaaatgcggtaaggacctttcagggggatatgtgcggtgctcgcattgccgaagccagcctgccatcacgcacccagcaggaaaattggcgcataacatgccgcttgctgatcaatccccgatgggaaatgttggatctgatccaccgagcttgggcagactcacccaggacagacttttcctttcaatgaaagatggcgtggccttgaagccagttttgaacccggctcctgatcggcgccgtctccgggatgctctgtggccccggtgccggaccggccccgatgctgcagttgcagaagatgaagattcaagactgctcattggaccacgaagatctactggtggtccagattgtggtggactcttgtcgccaaagaccttcagataactaactagtcggacatcttggattattcagtgactcatttcctatggtgagggccttaaaggcctttaaagcccacacgtctcgacaacaattgaagaagactccggaaagttcagtttgaaaggggctcagtctgctgtgctacacgacgcgcaagcctcagccatggctacagaacgctgtttcactgtccccatcggagagatcgaccattccggtatgacctcatcgacgcctgtcccttgcatagctaaccctatctacctatcccctgatagacccaaattggaaccggaggaaagatgccattccctccaccatcgtgataggaaaaatgtgggcggacggtgaaggatacagattcacccggttgacggaagatcaagtccttgtggactttgatcatgagtctgcgaaaaatccggtcaattggactcatgtgagtgtgatcaaattaacaggttatgaacagatcaagctaacagcaagccatctgtgacaattagagaaagaaaatgtacaccgtcctcacagcactctttctggtgctcaactctggaatatcgtcctctttacccagcaatgtcgttccagctatgatgcgcgaattcaatgtcacaggtgacccgcagaaggttctccccaccgctgtctttcttattggatatgtcgtgggtcccttgttcttcagtccattgagcgagacaatagggagaaggcccgttctactttggagcttcaccgtgtttcttttagccacgatagcgtgtaccttcgccccgaattggccagcgatgttggtatttcgattcctatgcggagccatgggggccgctccccaaaccgtggtaggtggagtctacgctgatatgtttgagactccacgtgctcggggccgagtcatggcattttatatggcggtaagctgtctcacacagtgtatttgaaggaaaggcgtctaataaccacttaggcggcgagctttggtccgattgttggccctattatttccggctgcagcgcgcagtacggctggcgatggtcattccgcatcgatcttatccttgttggctgtagctggcttagttcgcttttcctgccaggtgcgtgagcgacacagcgttgtcatctgccctgttgatgttcccaaggaagctaacgtctagagcagagacatttagtcgggttattgtcaagaagcatgtcgccttactaaacaagcagtcatccgcccatagctatgtctctcagcgagagttgcagagtgccgcagttcaatgtaccttgaaagagactctgacgagacccatcaccatgatgttcactgagccgattatccttttcactggaatatatttggcttttgcttatgggcttattttcttttgcttccaggcctaccctataatctttgaaggtacttaccctctcgtacttcctctgtcaagagaacggaccaacgagctttgcgctttgcgctgtacgtgtgaaggtttgctgactctggcgacgcaggtacctacggtttcaatgtcaagcaaacatcgctgtgctatctacccagtaagtgcccatcgagaagaaaccgtcatgaattcccactaagtccattagttggaattggtgcagcatcctctggccttgtctcactgtactacgacgtcatctatgagcgagccaaagcgcaagggaagaaatggacgaccattccggagctacagcgactcccggtagcctgcattggcggaccatgtctcaccattagtcttttttggctaggatggaccgccaacccgcagatttactggctggtgccggtgctctcgggtctgttctttggcttcggataccagattatcttcatttcgctgttgacctatgtcaccgatgcgtataagatctattctgccagtgctttagcagcttctgtgatcacgcggagtattctgggtgccgtcttccccttggcagctgatccgatgtattcagcgcttggcgtcggatgggggacatcggtcctgggctttgcaagcatggcctgcattcccattccactggccttcctctatgccggagagtggatccgcaagagaagcacattctgccagcagctgctgaaagatgacagcgccacagaagataaccacgtcacacgccctgtgactccggaagccgtttgaattactcgtgtcacccaagcgggtgtctgtctcttctccgccatctacccattgtgggatatatacctacgcatattcccgaaaacgcttgttgagatctctgatcttacgcctacgctcaaaacagcccagatctagtggctatatcttctcgacatgacttccaagcagtgtcatcctccaatcaaaacattcgactttcatttttcacctttttcttcgaacaaaatcactaatcttaagactaatatcgacgacagtctgtccttgcacaaatgttccacagcaaccgttggggtttgcgctaaggatgcatggaggtttctggttatggataatggatttcggtagcatagaattaacggcctaatgtgacagatagacctagatgacctaatgcatatttacttagcctgactgcatgtactgtctaatacatatgcttttctattgatgatcgccagtctgtggttgtaataaaataattcacatggctcggagctcgtctaacaaggagcattgggtgtttcacagtgtcatgccagtgtcacctgtttaaatgtcagcagatttcctgcaactttgaggccgtgcaagtgttgtctgaccccaaaattgcgaataaacttgcatcagaaaggtgaactcgtatggcctttcttctttatctcttcttccccgctatagtgcccgtactcttctcgtctcagattccctatcatcatttgagaaactgcgtcaatccacgatcttagacctaagacactgtcgagattggccatgaggctcgcagcttctctcgtcatatgtctggctacgttagtatgcgcccgagaatgggtgacgaccacggaaattgaatctcagcggttagacgaagatgacgaggctgcttccagcatggaagaggttagttctataagaggggaagtgattatcagaagcacagctcatgacgactgtctagattggcgttgaaacaggatacagcattacttgttacgacagcactcggattccggcatgcgatgtggccgaggtgatcaccctccttcctgctggaccacagactactagtattcacgatggaatgatagttgttgatggagatgagctgctatattcgtgagtgttgtgcccgtgtctaagccattcagtctaactgttagagacttgtagtacccagatgacggcacaacccattgaggaggagcacagctcatctatacccgacacagtgactgcggaaaccacagctgaagcatctgacatcgaggtcaccatgtcgtggagtagctccagtctgcctgcctccacacatatgatgagtcgaacaacatccggatcagttagtagcaccctaagtgctgggcctggtgtggaaagtgttcagggcagtatgagtcttatgactactcagagtcgtgcgtcgagtacctccctaaccagctcgtcggcacgcagcactggggcggcaccaatagcgacgggggagctggctatgatggctggtgccgccgcgatggtgttgttggttgctgtcctgtgaggggtattttgtggggttgtgatattgaggcataagttgttatgagagcacaaatatgtatcaagaaagtggcgggcagtggggaaagctgccggccaactaataacaatacacatgactgactttggctctccacatcttcaaaccataatcgaaatgtcactgcgtagactgactctaccatgcaacttaacgcacagctggtctttaacgccggttgccgatcgggcaatcggcaataccaccccgcagcatcacagccaccctctataagtgaagtccaacctactactccctactgtcctccccacatgtatatctcacactaataatgacacctgcacagctacacccaagcttctcagatcgaaccgatttcgagaacgcctctcgaggctggattgggtctctcgagcccggcatcatccgagcagccgatggccaacccgtctacaacaacgacgcctaccacttcctgcagggatcagaatgtcccaaaacagcaaacccaaagctatggagacagggccaattggcatccatgcagggactcttccaggtcgtcccggggatctaccagatccgcggcctggacctcgccaacatgaccgtggtcgaaggcaccgagggactcatcgtcattgatcctctaacttccgtggaatgcgctgctgctgccctggcactgtataggaagcaccgtggcaatagacccgttacgggggtaatatactctcattcccatatagaccactttggcggagcgcagggtgtgcttcctgcctctgacgcagtccgaacgagccccatcccgattgtcgcgccagaggggttcgtagaagaagccctgagtgagaatatgtacgttggtccggctatgcgtcgtcgcgcgcaatacatgtacggagcccagttacccaaggctgcggacggtcagattggctgcggcatcggcatgaccgtgtcgatgggaacaaactcgttcgtgcctccaaacactattgtcacctcgactggcgaagaacgaatcatagatggcgtccgcatacaattccaactcgtgcccgagacggaagcgccagcggagatgaacttttatttccctgatcaccgcgcgctgtatattgccgagtgtgcaacgcacagtctgcataacatcatcacgctgcgcggggctctggtgcgcgatgcgaaagcctgggcgcggtatttggatgagtcgctggtcctatttggccaggagtcagacgtgttatttgcgggtcataattggccgacatggggctcaacgcagatcgagcagttgctgtccgagcagcgagatctatatgcctatctacatgaccagaccgtgcggatgatgaaccagggtctcacaggcattgagatcgccgagaccctgaccctcccgccggcgctgcagactgcatggcatgcgcaggggttctacgggtcggtcagtcacaacgtcaagggaatttaccagcggtacatgggatggttcgacgggaacccagcacatctatgggaatatccgcccgtcgagaacgcaaagcgctacattgcctgtatggggggcattgacgaagtggtccgcaaggcagaaggtttcgcgcaagacggagatctccgtttcgccgcgacgctgctgggacatgcagttgcatttgatgcaaagcatgagcaggccagacgcacgctggcatcggtgttcgagcagttagggttcggagcggagaacgcgacctggcggaatttctacctctccgcggcgcgcgacttgcgcggggagcaccagccgccaaatacaaataaactaccgtcgaggacccagagtcgccaattgaacccacgccagtcggtggagcagtggctaactctgctggcggtccggctgaatggaccagccgcggcgagcgaggcatttgccctcgatgtgcatgtgacagatgagaagcagtggtggagactgatggttagcaacggtgttttaactagcaggaaaacctccgatcggacggctattcaaggcaagacaacttttacaatgtctcttacgaagcagcgactgtgcgaaatcctgagcggcaatgcagatcttggcgacgtcgaacaggagggcgatgaagcatggctccaccgatttctgtctttgacagcgtgatccggcagttaagctgcccggcctatcaaacagaaaccccttggataaatcatcatccaggctcaaaaggtctgctcaaagggcttgctgtttgtggtggaccaattgttttcgtttcaccatcccgtgtctgagaaagccctaagcaagtcgtcgcaagcgaagagaaaaaaactgagccgctaagagtcgcgaggcgaaaacgttgagaacgtggaaagtgttgaagtttaaatttgttccagaacagactaagcgccgaaccatcggccgaagaaatgaaactagactttagtcggcgagggatcaactcgtggagattgacggtgcatctgcattttgcagatgtcagggagaaaagtcctccggtgatcttacgacggcgtggatgtttatcttgatcgtagaggctgataatcaatgttcaataaacaccttccttgatttttccagacttctccagccagtgttccaccatcagacacacctctgtttggccgtttttgttgggaattccccccactgcgaacgggcggatccgtggaactggcctcgactttgtccgttttccgcacgccgctagtccttccccccttgtctaacgctgatcctttgggttcagattagctgggcttgtcgcagaaaatagtactttgtaatactggaaagaggttaatgccaatagcgtggctaccatgggtccattcctccaaaatcgaaagacttcaggaactgcgttcccctgattggacaatggctgcgtcagttaggagagaccctttgtctttcacaaggaaaatttagatccccaatcgtacaagagtcgcagtgtctgacgctgcttctttgtttgttttctccctctctgcgcgacttattcgatcatggctgaacttcgtaaggtgcctgccagccaggcggcggtatgtctatccctttcttcatcacctcccccctttgaaaagccctaattggctaacagctcccttttgactttgacagcagcagcagcagcagcccattcacaatgacgataatgtccccagcttgaagaccctcaaggacgccattcccgaggaatgcttcgactcctctgttgtcacctccctcctctacctcgcccgcgacatcctctactgcgccatcctcacctacggcgccttccacatccacctcctcccctctctgccgctgcgcgccctcgcctgggctgtctacggcttcttccagggttgtgtcggcaccggaatatggattctggctcatgaatgcggccatggtgccttctccaagcatcagaccttcaacgacattgtcggctgggctgcccactccttcctgatggtcccctacttctcctggaagatcacccatgcccgccaccaccgctacaccggccacatggagaaggacaccgtcttcgtcccctggaccgacaatgaactggccaagaagaagaacgtccgcatcgagcagctcaagcatctcaccgaggaaacccccatcgtctccttcctgcaactcatcggccaccagctcttcggatggcagctgtacctcttcctgaatgtcaccgccggtcccaagagtctgcccgagaatcgtccgatccgtggcgcggccagccacttcaatcccttcggcgaccttttcaccaagtcgcagtatttcagcattgccttgactgatttgggtctgcttatcatgggttcgattctgtactacgcctctacgcagattggtgcatggaatgtcgtccttctgtactttgttccctacctctgggtgcatcactggctgagtatgtttctttccttttatttctagagtttgttgaagaagaaggaagtgctaacaaatgaaacagtcgccatcacctacttgcagcacacccaccccgctgtcccccactacactgccgaatcctggacctacaccaagggtgcccttgccaccattgaccggagcatcggcttcatcggccgccacttcttccacgaaatcatcgactaccatgtcgttcaccacctgttcagccggattcccttctacaaggccgaggaggctacccgcgctattcagccgctgttgggggttaactaccacgaggagaaggagagcagcttcttgtactcgctcatgaccaccttccggaagtgcatctacgtttcggatggcaagaagaacggtgtgttgcattttgtccttcccgaggaggcaaagtagacgtgcgtaatatatttgggtgattgaatgttgtggtgttcgtgggtgtggtttactagtaaattagagtacaatatgcatatatagactgttgatagactttgatagacgatcacaatgtattatagactcaaagctactagaacgcgatatgtgttcatgttcaaaattctacagaagaaccaagaccattggtgaagcaaccaacatcactgtcgactacaaaagagatccttaatctgggacattatactctcgccacttttcactgcaaaggttagctagtatcaactaatacattaaacggacttaccatcgtctcttctgaaaaactcctccaacttcgcattcagatcttcgctgagcctaccggtgcattcgaacacatctcgtttcttatcgttctcgaggatgattgtataccaatcagatccgtcgttcctgtcattgttccacagaatcttcaggccatgcgcccggcattgggccaggactgatgccgagaggtgcggttgctcagggtggggcatggtcgctggggttgtctggaagtgtaagccgaggaagataatcaatgtatcaatcgaaatgaggactcacctatgcaaagacggacaaggagtaagggtaaagcaaggtcacgttggtcagatgtactgagaatatcgatacacaaaaaataggcaggacgtgaaggtctccagaagacctcagggggcttctagaaagcctaatttttttttatatatactaaattacgtctaccgatagcgagttgaagtcgggattatccgtatttctgtcactatgtttatgttggatgaagtatcaccatgtttgttatctgacattagctgctacgaattaaggttgtgttatcaagtgaggaggcaatgggtgttctgtgttactcatgtatggagatgaccgtacattgcgggttttcatctatatattaacctcatactttctactggtgagacatactgcagcatgtctgtctatataaccacaaagagggacacgtgatcgtatatcatcaccaactatgaagacagtccccggacaatgcctacaaagaaatgcaactcatcggaaagcagagcaggatatcaaagaatctacttacctatgacagcacgtatcaccatatctccaaaacatgctggcttggaggctgctactcaacagcctgctgaccaacaaccataactcttgtagcatatgacatgtctcaccccgtaggcatttccctttcagataacttgcatgcaacttccatccatccatttgaacatataagagaactctgtgtaacccttgatatcaagtagatgcaacatccctgcactccctgcaccgccctcacccaatcaacaaccatcatgcctcgaacacgttcccattccatgccctactccaccccctatccttacatcccaacttccctatacacccacccaaccgttcccttctgcgtctccccaaccctcgactacccccagagtgatgcctcctcttctcccccacccagccctccccaatccatcaccccacgtcccctctccccacccccagaccaaccctcacaccccccaccagcaccacccatcccccacagcagctaccccaaactctacatcctcgatggcgacaccgctgccggcctggcaatccgctacttcatccacgaacgcggcggtgtccgcatccgcgccggcttcatcgacgtccaactcaaagaccagatcctgccctccttcatctgggaacaggaccacgcgggtgaacttcccatgctcttcctcgacaatccgacccgtagaccggtgcgcaaagtcgtcggcttcgaagccatcaccgagtacatcgatagcgtgtcgccgacggaccgctatctgtacggagatacggagcaggagcgggcgttgatccgctcgtgcattcattgtctgcggcgggatgtggtcgagccgctgtatgagtggaataatcattacttggggaatcggaccggtgaagaagtcactgggtatgcgcctgtgccgggacggagaagggccctgcaggagaggattgagatgacattggagcaggtggaggagaatctggaggggctggagtatcttctgggcaagttttgtgctgcggatgtgtatctctttgggatggtgattgcgcatgccgatcgctggccgtggttctttgatgatgaacggagaccgagagtctcggagtattttgtcaggatgagtgagcggcccatggcgcatttggcggatgagttttgggatactacccggacgaccgtggtggattaggatgatgtttggggttatatatctgggacttctgtggtttgtatatacagactgtctaatattgtgggagtttgttttctgtcaatatcgtttgcttgttttgagtccggttagttcatgttcaaattgaacggtctgctgtagtatgtcgtacgtgggtgggtcaagcattggtcatttattatgacagcttctgggatatggattggaatgtgtatagcagcgttcatcctgacgactttgctcttatcgcactataattttctagatgtaatataggaacccgctcgggccgtgtgggaagcaccatcgatagtatgcttcgaagctacgatctcatgagttgcttaactttcggcatcccctccgttagcgccatggcgcccaacaaggggtctcggtgataaacccattatcattggccgctgtggattagcgtcttagtggcgctgccccagcccgatatgaattacagtatcacagcatcgggactatggctaactccgtgctgcaggctgtcggacagctatttaaggacctcagcatggcattgcaaatctcatcttcccagtctagaaagcatcagaatcgttgtcaacatgccatccttttccgcacaatccaccagtgaagaagtctgccaagtcctggcggaccacatcaaagggagcaaaggtacgtccaaccatccctcctcagtatttccggatcataagaagaatctaacctctcagtcctcattactggcgtcacactcggcagtgttggcggcgaggcggctcttcagctctcccgccacgcgccggctctcttggtcctggctggtcgcaacctggagactctccaggccaccgaaaatgccatcaaagccgagacaccggatgccaacacccgactgctcattatagatttgagctcgcaggaaagcgtccgcagggcagctgcggaggtgaataactatccagagcgccttgaccatcttatcaacaacgcaggcatcatggcggcaccgtactcgaccacgccagagggagtggaactgcagtttggaataaatcacattggccacttcctattcacgaacctgctcttggagaagatcatgagcggggagtccaaggttcgggtcgtgaatgtcagtagtgccggccataagcgtggacctgtgaggtttggggatgtgaatttcgaggtttgtgcagtcccgtggtttattctttcgttcggttgcacgcgagcaagggagatttaattgacgctatggtagaatgggaaatgctatgacaagtggcaggcatacggccagagtaagacggctaacatgctcttctcggtatcactggcggagaaggctgggaacaaaggagtggagtcattcagtctttatcctggccgacgagagactggcatcggaagacatttgaagccagaagaatgggtcaaggctggtatgtagaacttctgatgtgacagccaattgtccggtagtgtgaaggatgctaactcgatgactcaagggtggaaacatgaggatggaagtatcaatgatgaccctaagctgaactggagaactgccagccagggagctgccaccttgattgtagcagcatatgatcctagcaattctggtaagcacgcttcaccaatatgggcgggtagatggtaacgaattgcagacaaaaacggctcgtatatggtcaataatcaagtaaacaatgacgaggcggtggaatatgctctggatccgaaaaatgcagaaaggctgtggaagctaagcgaggagattgtcggccagaagttcgaatactgaatctttcctacgccataatcaccgtatgctgccaaatcacatttgttggttcatggtatttgattgtgagatggttaaatgacagatcatggagtgtgtatgtaattatcgcctttagcattgaacgagcaataagcttgctgctacagtcgacactgtagtttctgcgctgcttggcctaccgccgctgccagtataatagtccccagccccttgtctgcgcatcccacctggcactgggatatgcggccaacaaagcgatggcagagaccggtagccttcgccagacgtcgctctaacatcgttgcaggtacatgctgaacatcttggattcctcgcaataccttggctatcgtagcataaaccatagtcattcccagccagtagaacaataacagcggcacatcatcagctttcggtatagacatcttctcttccggcttgccagacggtgtggccgtgggtcccgctgtgggtggcacgatcatgaacaaaggatagcggctttctgactgccattcgtgattccagtgcaagagctttcgctcgagactgacagacactcgtatcaagtatgttgcagagtcccacgtaatcttgttgcgacgaagctcttgttgtgaatagctgtgtagttgacctaactcgtacagtatatcgaggagtatgtcaaacctattagctgacggctgtgcatgtgagagcaaggtgaaagaaggctcatgattgatattggtacatatatgaagatactgaaggcggtcaattagacgtgccaggtcatggatgaagataaacccacctcaatagtacgaagccgacgcaaatcctgtgctgttaacatctccgtagcggtgttggattcactagctaacttgcaggctgcctgaacgtggacactccatgcatggtcttgccctgatggttgtgcgcagacctcgtagagtgcaaggatcatggcagtgcggacgagatcagagcagtagtctacttctgttagtgcacatatttgccgcattgcttgcacgtaatgttgtctgctgttatgtgccagcgcgtcgtcctgttgcaaggaggccatatgtacaagtgtcaatgcagcgagggctgtcttgacgactggcgactcggactgaacgaaggaagaaaatagttctacccagtggacaggcgactggtgcttcgtcgaatctggagcctccgggggtaagtagtcgcgcagaaagatcgagaccaattgtacttggtgctggtacaccatcaaggatcgaccgttccgtccagcgatggcggtgttcatgggacgtgtgtgacttctatttagtcaacgaattactccaaactatactagggcggtagcagcaactcacaagtcagaataacccccacaattgcgagctgaggattggcaccgcatacaagcaggccgggtcttgtcgcactggcgtgcccggaaagtaaggcatcagcactagttgtctcggtcgatggaccacaattatctcaccttgaccttgcgcagcaggcaagtccgacagctttgagccctccaggtgctccgacccatctttaagatacaatcctgtcctcaactgattttgtcgcatgaatgccggatggatgtcaagaagaagggaaagcttgatggatggcgaggctaacggctcaagcgaccgccggcacatgactacgagggtgattagcggacactaattcgcttcagctaatcaataacgataaagccaacttatgttgaatcttgcttccttggattttagtttcatgaaaaagtctacgtgctctctccacccccagttatgccctgtcaagcctccgaacgacccgaaaacacatccatcaactgcaaaagactatcccatcggccgtccttttgaacctcaattgtgccctctggggtcatcaccttgtactcatctgccgaccgtgtgccatactcgtaatcaggctggtcattcacaaaggccactagatctcggatccagtcatccatcaaaatgcgctctgccgggctgggtccatgcatgatggagtaactggatgctgtcagtactgtctctagctagggtgacgcaggtttgcttacttccatatcggtctgtccatgctgtgactgaccccgaaggatgctggcgccaccttttcagtgatgaatgacattcggtaagcgatcagataccgccagacatccttgagctccaccccgtgctctaggagattgttcaccaaaaaccggtagggcgctcgaacctgcccgtcggcgataatctgtccgaagacagattgccattcctgcttgtctgtggaatctggtagggcgtaatgccgtagtagacggtccgtcgtggcaggagaatagtagttcgatacttgcagtttcatagactccacattggcctccggaccattcgtcacggcatacagtgtgttttcgtcccggacttccccaatgaacaaccgcaggccgcgtttcttgaactcggcggcgaaagatccattgcgatagtagtcaaagacgcctggatggatgaagacaccatcggtgaccggtcggaaagtgtggtgtttgagtttcatgatcgcatcacataggtccggtgcacttatggctcgcagcttctccaacttctctgcccctgtcaagtcttctggaatgtcaaagtgctgacacaattcatcgaactgtggctggcaatcttctacagtcttgggctgggatggaatcgcgttagaatgcatgtacagtctgcggaatttgttgcgcatggcgtcctccatctcaccccggaagtcatagagaacctgagcttgaaccgcgtaagcgccagcactgcgacccgagattgtgatgttctctgggtcgcccccaaatgcagcaatattctggtacacccattccagggcgagtcgctggtcccaaaggccatagttgccgacttcttggccagccgactcctcccgcagcgcctcgcccgccaagaatccgaagacattcaatcggtagcccactgcaatgaagatggcattcaactttgcagtggaaatgagttcggtggggtccattcccggctcttggctggggtcgccaatctggaaccagcccccatgaaaccagatgacgacaggccacttgggattgcatacttgggggtcaggaacaggtgtccagatattgaggcgcaaacaatcctcatggtaggtgtgtttaggcccaccatgggagctgacggccttggagtaaataggctgcgggcagaccggcccaaattgcgtcgcatcgtaggtatccccgggctggcctgcggggagctgttgcaaagggtagggtcgaggtttacgccatctcaagtcaccgacgggggattgtgcgtatggaatgccggcgaagcgtctcgattgggtgccattctgcaaacctttgacagagccagtcgttcccggcaactgaatctgacactcggatgtttggtaggagatgtggtttcccatgttgcgatagattcactgatttaacattgataaaatggcggggcttggaaggaaaggataacagcgtggctttttgaagcgttgaagagaggaggggtagtcaagagtttatatccagcatagccggtcgccgatagattgtgctagtatactagtagatactactaagtaaagactattccgttaagtgccctggttatctacctgcgtgaggggtgcgggcgccataagccccagatacactcttattggttggtgggctaacggtgcctgtgccagataagatactcgggtttgggaagagatcggcattcttccgacacgcgtgaggggattccggtcagggggtcggagtccatgaaactgttgaaactgtgatcctactggttcagggcagagtgtaggcatccgtcattcttgttcatggtccgtcggcctctatttttaggcaccgatcgatgccaaaaccctaattaagggacagggacgcagcaagatcaggttatatgaccctccatcgggctgcatcttgtggccgaccaagacgccaggcaaggcttccccggcggagacttctgaaccaagaaactgacgccgttgtttccgtcctggaatgtccagaaagaaggtttgagctggcgaaaatttctgctgacttcacgtgaccgtgcctcaggtctcaatcccccaagggggcaacttcagaacgaatacgatgatctcaatcctccacgccaaccatgaacgatcagctgcccatgcagattcgctcgcggaggtcacacaataagtcccgcgcaggatgtcagaattgtaagaaacgccgtgtcaaggtaggcctccaagctgcatctgcccggtggaaatcggatgaacgctttcaaccctctgcagtactatatatactacttctcttctactagtactatatggactatagagcattttccaccacaatgttgtctatttttcgtgctttggcttgctttatccccaaatctgccacatatgcacccctctccggtcatactgactctccccagtgtgatgagaaaaagccacaatgcaccaaatgtgtgcgacattcgatcgaatgtgattttgcttccccggcctcgtcgacctccccagatccaacccgccgattccggtttcgaccatccaaatatcaacccggttcacgaacatcacctccaagcagctcagctgcatccgcatctaccggagtgcaatgtgatctcgccggcagtggcctttccggcggcatctcctttgccgatctgaagctctaccaccattttgtgacctcgacctacaaaaccttgacagacgagaaaatggaccacaaacgcgtctggtcacatcatgttccgcaatggggtatctcgttcccctccatcatgcatctaatcctggcgctgtcggcgctgcatctggcgcatggggatcccgcctcgcgcacgcagttcatcgctcaagcggacgatcacttcacctttggcgtccgatcggtgtctgctgttctgtgtctgctcaacacggaaaactgtcagctgatctacatgtctgcggcattgatttgcctggtgtatttcggtcgtggaccccgtcatggcgagtatctggtgttcagtgacaccggccagtccgagtggctcgttctgttgcatggtgtgcattctatcatctcgcaaaatcatgatcgtgtcttcaccggagttctagagccgataccggacaatagtatcggtggggtgagtgccgagttgcaggcagaactggacgagcatctgcaacaggttcgacaagtccaggcttttatcctgtctcatgttaccgatgaaatgtcccgagctatgtttgaagctaccttaaatgacctgcgctcggcgttagaggaaatatataagatgcgcagcgctgggaaggatggcatctgtctgatgcatctggtgatagggtgggtgtaccgtctacgggaggagatgatttcccttttggagcagaaggaccgatacgcattggttgtctttgggcattggagtatcttactggtgtatatgcggtcatcgtggctgatgcagggatgggatgcgcatgtgctacatggggtgcgcacgtccttgggagaggaagaccagcactggcttgcgtggccgatccaggtgattgaagggggagcatctacacctactacttctctactgtgatagttatataataacagactgtatattcttatctacatatgaacgaccggaataacgaatcaaattaaagaaaaacatcctgaacccttcccaaaccatatgcaccaaaataacccaatgacgaaacaaaactagaactaatcagagtacacagaaaatcttaagcccccctcccctcatccccaatgtctgtcatgggctgacaatactccgccgcctccttggtcctcctcgccttcttaatcaacgtgcccggatgataaaccgccaacacggccatagaagcaaacatcaacgcggcatcaaacacataaatatacacctcctcggtattcaagggcgatgtctcgttggccccaaactgcaccgtccggaccaagtttctcaccatcaacgtgccacacgccacatacaacgcccacatataccgcttccatccttccgtcaaccacggattctcattgaccacccacgtcggctcgcgactcaaccgcaggtgaaatacgacggccacccacacaaacaataggaagatcaccagagagaaaatcaatcctgccaggacggctttgatacccgttttcatgaggtgctcgtcaccggtgacttgcaccccggcaccggcgatctgcgtcaggaagcagatgacgtcgttgaggacgaagatcttggtgagccatttgggtcggataacggagtggtgctcggcggcgaaggcgacgatcatgcgtccgaggatcatgtagatggtggcagcgatgaagggcggcgcgcagaggatgagcatctcttgcaaggcccaggggccgatgagggtccggccttggtgagaccaggcacggccatagtagccaaaggtttcacctgatgggagattctgttagatggatggatgaatgagtggatggatgccatggtagggcttggggcagtggacagggtaaagaagggctcgacgcacatattcccccgatcacaagcgggataaagtatgcggcgcggtaaggaaacatcatgacgaagtggacaagggttgcaatgccgaaaatggccatgaaggcgtacccggctgtcgcagagggtgtgtaaggatagaagtcgacataagggtcggagccattgacaccggggtggaattgaaagtccatgatgaaagttcacggactgaagtgaaatacgattctggcttctaagaacggttggatgtgtgagagtctgaaattctcaatctctggattgatggtcttatatgtaagatgaccctggaggagatccatggtggtattaccgaatcgggtaatttgtgagcgagtacgagcgggtgcgcgatgagcttgttcggcgggacaacagtggagagggctaattttagctgtcggcgcaacagggacagaggccatgaagataagcattttccaagacccagactcgttccgtgtatgtttcatctgtgcctatggtcttgcatttcttgcccatgggttgaactgtggccaatcccttctgcgggcagatgcgaggcgccacaaggcagcgatgattccgtagaagggagactctcaggaacccaaactctgtgccgtcctctaactagtctgttttcagatttgatggcacttagctcacgacagctagagcagtgccgatcacccctaccagttccagcacgcctacgcgtatatacgagaatattgcaagaaaactaggaaagttctattcgagcgacggaaatgcctccaatgcaagactccgcaagtctaatctatcacgctaactccagaattgcatcaatcgtaatgcgtctatttgccaaagaccttgaagcggtcctccaggggcgcgaaagccttctcgccaggctccgaggtagggacgccaaagaccagctgagcgtcgagcttccaagaggccggcaggttccattgcttctggatctgctcgtcaacgagcgggctgtagtgctgcaggttggcaccgaagccctcggactccagagcggtccagactgggaagggagtcagcgactgttgatgacacatggtaaagcccgtcatggaccgatgataattgtgaaagagggtcgatgacttaccaaggtactgggacatggcattggactccagggcaaaggggtcaaacttgtcggcgtagatggcgaacttctccttgataccggcgagggagtcataatcgacgaagaaaaggacctaatgttgggttagctggatatgtcggtcaagccagattataagggcaaacagaccgttccgtagcccgcgcggaaggcttccagcttgggcttggtctggttctcaaagttctccttggggaggtggccagcggcaaccagaccctccatggcagcgatggcgatgtcccagaccttctggtgctcctccttcagcagcaggacgacgcgggaggtctgagtgttgaaggagctgggcacgtgcaggacggcatcagcgacgatgctctcgatggcatcgtcggagatggggctctcggccttgaggccgtagtaggtgcggcgggccttgaccagctccaggagggaggtggtggcagggtttttgaattgcggctgagtggaacccattgtggaagtattatagtagaatcgttgatttaccgatgaagttgaatttgattgatattgatagaatgtcagacttgatgtcggggcgggactacggcttatatagatatgcggtatttgattttaccccgccagtctggtgggggacatttttccattctattgaacactttcaccttcctcattatttttcattattatcaatctgcattactgtggcgtgattaccacgctcgaccaatcaggatttgtaagccggaggaagagaccctcactaaacactcagggaattaatcagctcttagcaagacgcggaattagctgcctgccaccggaacacggatttacgcctgtaggtaagcaggtgctttcgttcatctttgcgcacagattctgctgcaaacttccatgcttctctcccttagtttatccagtgaaatatatagttactatgaggggatgcatgaatgagtgaccggaattgaagtcaggcacgtgaggacgattcctttgatgcctgaatgaggagtcacgactcagaggtccacgtgatcggcactcttattcggcccgacgggcacatgactttcaatatgcctcaggcagaaacacagatgatcctcggccaagaattactaactctagcactgcttcgtatgtttctatgcagttaacctcgatctatcctactattatctagtcctttatctagcctattatattccctcgcgattcattgtactttcgccgcctctatgaataaagcttctctttcgtagcaagctagctagcttcatacctattattcccggcacctcatcacctcgcatccgacgtcaacaattagtgctcacctatttacccggaagcatgactggcgtggaaatagatacaataccctgacagaatacgacgattataacaaaacattaatttatcgaagcatcaacctgaaaacattctaatctatatgccatgccgagagaccaaaaagaaagacccataatgacacatccgttacctgttgacacgccgaacattctagaaagtaactagctagaggccacctgaagcgagaaagcgaagaaagagaagaagcccttaagaaagggagatgcgatgaccgcaaaaggggaagagggttatctggctgtcccacgaatcataccaggtgcagctcgttttttgcggggtgtaccagctgggctattctctcaacaagacgagaatcaggctggcgcccatgtgtggtccacacttcccattggatttccagttgtgcaccatagttaatgacccgtgaaacttttactgggtactcacggtaagccacctgcccccgccagagcgtctccaagctgtgctgcatttgggtgggtgcggtagctggggtgtaattcacgaggacggctaagataacatgttagtcgccaagggagatccagcccgacgaagggaaggctagaagatacgcgaaagagggatagagagatactgacgtggacttccatctggcggtcctaagctgaacaggttgatgttacgccccatctcattgggccggaagcgtactaccgctgggaactctccttgccgcggaacatccctgcaccccttatagggtcaatggtgttagccaatccctctctcacactctgccatgtctcctgagatagccgagatgtctcacctgtctgatggcaacaaacgtttgacagccgtttgtaaacccattgtgccctggttcgatgaagggaagggaaagctcatagcctttcaagctctcaacgcgtcgtggctgatcgatcgcctgcaataccgccccgcgcgcgacggcactaatactaccaaaaaagtcaggatctgtatccctgcctgggacatggcgaaaggcattaaaccagggtgatcagaattcggtttgacttacgcctgggttatgggacccaacaactctggccggctgtccgcgggaagatcgtcgaggcagtttcgcatgtactcgcggaagtactgggatttactcattcctcctaccacgacgaccttggttactttacctcggtatcctccgatcatctgcgagatcaaatcataaaccttggttaccagcggacgaaaggcggcgacgagatccgcgaaatcaaatcgatgggggacaagagcctgccccctcaagatctgaacgtcaacgtggctcccgtcctcgccagtaaactgctgcttggcttcattaacagcacggcgcgcgatagcagcaggctgaccacgccggaaaacctgggtgctgtggaacctattgcgaagttgctggaccagacctgaatctacatccacacccccgcaacggatacatgggccggattagctatcaatcacaccggccagaccaaccgtaaaccaaatgctgtcagtacatacttcttggcgcgtgcggggccttcaagtcgtggggcggtaatccgtccacctcgattatgtctagatcctacaacgctccatgttagcatgactggcccatccatgaccctgattaagcactcttaccgttgtggctccgccacaatcacaaactaggagcacatccccagactgaaccccaactagtcagttcgtcttgcatatcatcctgaaaagagagcgggagatgttggagggttgttgctcacctggatgccttgactggccctgagactgaattcaacccatcgggccgcagcccaagactcagaagtgtatattacctggtggcctggcaactcgaggcgggcatgcgtaacggcatctcggaatacctgcgatccaacaggagaccagcagcctggcatggccaggcaccaagttacctgaggattcaccgtatgtgtccggagtgtcgcaagaatttgcaatcgaagtgcacccaaaaagtccccgatgactgtctctactgatcttccacctgttgtacctattctcccagtcacgatgccttctagcttggatccgcgtatatccaaagccggcgatccgtcaacaagaagtttcgtccaggctaatgcgtcatcgcgatcgacagcctggtgaccccaaacaaatccaccgttggcatcgtaagccataacagacggtatacaccagtcatcatcgtttccaggcgtccaaacacggatggggatgttggggccggcgtaggttatcactatggcgaaaatcctttcaatgttagtggctgcccggcccagatacaatcaacattttcaccaagtcagatgaagaagtggggtgggggagggctggggttggagaagggtggcttgccagtctttgtaacaccaacgtcgatgcctacggagtatttgtctgggtttggttcagtagacatggttgatcattgaagatccagtataacgtggtgagaaaacgaaagatggcgaagtaagaaaccatagacgacgtctgatacttgaactttaccaagatgggccctgggaaaacacacgattgaactatagtacttatatctctaccatgtctctcatggagcgggggaggtacactattataatcccaaaggcgccagttaattttgaaagagtaggtaaatctgtccttccgcgcactcagccaagtgtctcgctttgccattattgcctttggcccttcctgcggcccctattctgaaaaacctaccagctaagatgtgttaatgttgttggtcctcaatgtggaagaaggttctggcggcttgagacccttaaggttggttaacttggggaatacgagacggttttcttatgaaaattaccacacgaacagcggccagaagaaaagaaataaagaaatatatatataaaaaaaaagaggaaaacaaaagaggaaacaacagatgggtgtgcaaaagtacccaaccaaaagagataaaaaaaaagatttaacagaaaagtatacaaagtacccaatgatgattttattttagccaaattggaataatgaccgttcgtgcatggggccgacctccttattccacacttgatcatgttcctttcttcgctctttgttcctttcctttcttttctctgtatattatttttcctatctttgtcctgtctcgctctcttcggcctgtttctcctttacacacccacacccacagacaacccccttccttctctctctctctctctcttttcctctgtgaaatctatcatcattgctaccatggccactcctagcagtcagaagcaaccttctaagcgttctagcgatgaagaaagggaggaatttccgcttaagtgtcagagcccagtccctaacccagccatctaccccaatgagatgtacctttgtcgacgagatgagtatcacgaaatgataaatcatcataaagctgtattttacagccgcaccagatacagggcggcagaggtgaccgtcggcgatgcttttgagtcggtatttgttcgagtgagaacatgggcaaccatgtggggaaagggagagtcactctcgcatctttccgattcggataaacaggcgattatcgccagcttggatgaatactgtgtccaggaagactgggatagcattcttctcaacctccctcctgctgctcgtgctaatttcggatgatcttggttgagtacaatgctaaatcagttcatctgtaccaagttcatagactctcccttttggttcatggacggaaagatcaatgccagcgattcagagacccagtctgacttccacaagaggttccagtacgtgtacgagaagctcatccagggtcagttcatgcgcaccactctttcctttgcattgtattatcatgttcttttgttctgctcttgtttcttcgtcccatccatccttgtttcttacttcaaccttctcaccgacagacaacctgatttactgaccctaacaaaactacaaagtttcccgcgaggatgcagcatggtggaaatccatcattgtcggaaagctcaacgacgaaccctgcgtgatgaacaacatcccgcccacccccgtcggccgcaccacggtcaaacatcgcacggcgctcgtgaagacctataccgatgagttgatgtgttcgcggctctttcagctcttgcttcgggatccagtgaccaagtacaaacggtaccagcgcaagaaggacctgcgcttactccttgaatgtgccgctcagaccgtcatccacgccgatggtggtctctacggcaatacgaacatcgtgcgactgccagatctgccgaaattcaatcactggtcgggccagatgatcgtccatcccttccacgcaggatttgaacccgtcgaaggaagtcgggtcttgattgtgacgcggccgagctacagctacatcgacatcctctccctcaaccacttcgctacggttcccccgtggagggcgaaccgtgccgaagtactggtggctgccaaggggagaaaagcacgggcactatgggcagcagctgccgctggtgatgaccgtgaagacaccgttggaagagacaaagaggaaggagacagccaggaagatgatgacacggaggagattgctgagcccgtcagggatctcccaccgctacgagacactttctggcggcagtaaacatgctctttaatgtgcggcactggctgttgagaatggaagtacctgaggggtgacagtaactgtgggcttgttggccaattgagtattttctgtcggtcacgttcagtttttgtattatctaactccaaccctggtccttttaccgccacatcgtagcgttctgggtgtcgtctgatggtacgagagagatcccctgacttggacgtgggcgtttaggctgtggatagccggccctgacacgcttcccgcctactactagtaggctaccaattctcctccccatctctcggtcagtgtagtcacgcttatggtcccatgattgcacacacacacacacagacacacacatgaatataaagaagtaaaaggactgctctttttatctatacgaagctagtatttgagtcctgtggggtaaatgaaccccccttggatgctactgaaatacggatacagtaataatggctaatgcctttggggctttcttctaccaaagagccatacttgcccgagaacctttgaatgcggaagagtggcagtagagaggatggcaggagcatgttgggcagaacgatggagggctaaagagtgtatgtaacaatcgtccaaggcatattgctttcccttctatggagtagagacaatggaattgatacattctagatacacaaacaagtctagtacaaacataatacccgaaatattaacatcctcatttggcttcatgtcttgataacagcacataaaaaggggcgattaaaaatgttatcagaaggaagacagactggggagaacaatctaagccatgcgcacaacagaaaagaatagggaacagtgagaacaagcaaaggaaaactacccacgtcgaaaagattctcgatagtagaaaggaatctatctacagatatcacgtggcccagcagggcatcatctcatccgctggatggctggcccttgctacttcgtgcagcactccggtgcgggggccctccgcctcgaatgtccagtccatggtgaggtggacgtctgcctccagtgaccacgatgcaactatctcatagtagcggacagttacatttagatcccggtgcacggcctcgtcaacgtagggggtattatcgtcaatttcgtgcggacacaaggtaacggtttccgcctctaaggggggtgtcagtccgcagccattgtaaagcaccggtataggatagtgtatactgactgccagccatatcacgccgtttaatcattatgttctctgagcggtgtcggctgcgtacactaagccggaatcgtactcgcccttgtcggggcacattatcccgtgcctcaacctggaagagagaagttcggagtgtcagactcaggatggcagtctctgataagggcaatcaaagaggatccgtaccaaggtaatagcagtcgtaggacgatattcggagtacagatcctcggtcccaagccgctcgatgaagctgctgtgaatttcatacccccatcgactcctatactgcatagggttgggggcgatccctttgcgggtcaagccgtatgaaacgatggtcatgctgtgaggcatggttagctctgtttgagaaaggggagcaaggcaactcacgggtcatagcccccaaagtagttcacaggcagcagatggctgacctcgggaatattggcaaagtcggcctgaatccgtctctgaaagtactgggaacggcttaagccacccacaatggctatcctgttggcgccgtacgtcttaacatgatctaatatccggcgcatgacgctagtgacaaccggatccatggccccttgaagcacactggcgctgaatgtgaaccgtccgccatcgtgatcgaaaaagcggcagttgccgttgtaatgttgttggagatagcgctgacgaagggagaggcggacatccacgtcgtcacgaccattgtacccttccttcgccgccctggcagcttcaaccgctaggcgagccacatccccagatctcagcggcagacccagcacctgccggatgtgctgcaaaagctcattctcgatgtgcggattcgtacaatcggccgtactatgttgggcgatttgttgaaaagacaatcgtcggggatgatttggatcgacccccgtgactttgaaagtcgtaaaatcctgctctatgtaagctttctgcgcagatttaaaccattcacctggacgtccaaatcgccttacattagtgacgcccccaaggtcacacacgagtagtttctcccctacccggacggagttgtcggtgagtctgtacgagaccccgatggcagcggccatcgcttccgaacagtaagtaatggtaccgccgttgtctagaaatccggccctctccactgcaatcatcatcatgcggactccatttctggaccaacaggctggcattgagaagtgccaggcaatggatgataggttcagagccctcacatcttccaggacgcggggatcattgcaaaaagccgaccggatcctttctagatagtcggttatgacgcgcgtaattcgtgtgcgatcttggtaatagttgaagcctttatctccgaggagagccctgagatccagtccattaactgatacaggcggagagccatcgaccagtaatttggaccaggaaactcgatcgcgatgttctctggcggcgttgccccaaaggggcggcctattgtcggggtaggccatgacggacggagtgatgggaatgcggttgacaggctgccactccacaacctcccctcggctttgcgcccagtacgtcagagctagaatgcatgtttcaattagcgcccgagtttggaagagggaagaagtgaaagggaaacaaaggcgagtccaacgaagaaggatcgtcacttgcccgttttgctggtaccatggtccaatccaacaacgagacggttcgggttatccatggtgagggtgaagtggaggttgtcccaatggaaaaacacaatacgtgattcggtaaaagagcacaggaacaaatacgggtgtgggtaagtaatacttgccctgagggtatatagcggattggaacgaaccatgagttgagaagggaatcatcacgctgctaggctcgcccaatttataagcttcaggtctcccggtctcctggcacttaccaacatggcgttctgcaacagaatgaagcagagactcatccagctcattagccatgtctctctcgctgtccctctgtcttgctctcctctctactttcctgatcccgtcgtcttgatatttcgggctctgtttccgccatcttgagtctatggtgagtgtatagactttcccggctacgccccgaatggatcccggacaaagaaggtttccccactgaaacccttcaatgaaagttcaataagggaaccggaggcgcagtctagaatgggaacgaaactgtatccagaaaggcaaacaagtcaactggtaatactggtaatatactgtccttatgatcctcccctagcaatgaaaggaaacccaaaaaaagaatagtatattagtatcaaaacaacagaaaggatccagaaggaaaggtaggaaataccaaacgtacgcttgaaaaggcaataagaaatggggagcaaaagtactcttccagaagctggaaaggacatcaacaatatcaaggagtcctgattctttaaacatattttcttctctttaaaccccagcccaccaccctacttaggttcacttcttccttctaccgcccttcccatcacttgagcttatctacatgtccatccttcctcccagtcatttttcttatcttgtgtctctccgggcctgaagtctatctgcacccagtctcactcattgctgcatctcttctcaaacccacttcggtgttcggttttccgtgttttcagttttctatcataatcctatctattagcttgctggttttctgtttcccctgcgccacagccatggtcaccactcgtaattctaaggtactcaaacgtgctaggagcgacgacgagtcctccaacgcagacgagggggcttccagcaactcaggcgaggaggttcccaataacccagcctcgacccacatctacggccttgcctcctatttctgcacacgggaagaatttcatgacatcttgaaccagatgtacgacatgcaagatcaaccttcatacaggcgaggttatcccaatgtcatgcatgatatgttcaacaaactgcacatcgctatgatgagctggacttggcaatggagccaagaaaaaggggccgagcatctctcgaatgatgaaaaacaggagatcattgccagcctccagggccagtgcgtccaggacgactgggacagtatccgagctctatctccgccggcggttcgttgtgacatgtgtggcgttctactccaagcaatgttttatcaattcatctttgcaatctttatcgaatctcccttctggttcatggatgggaggatcgattctgccgacgtagaaggtgatcctcagttccttcgacggtttcagcatctgtatgaaagactacgtgcagcaactggctttggtgcagcatgcttgaaatcattgatcatatcggagtccaatgcgaacggccccttcattggcgtgcctcatgacacggaactcgcccggagcaattttgcccgccgcaagacattgataactgcgttcagagatgaacttctcgggcgcagggtcttccaacttcttctccgccccttagacgatgaggctgtggtagcacgccgcaacgacgcgctccaggatctccttgaacaagcagttcagacaatcctctacactgagggtgggatctacggcaactccgtgataactcgcctacccgagctgcccgtctttgactacgaggatgaccgcatgacctcgcactattatcacttcgtcggtggtccccgcacccggggcctcgcacctgccccggggggtcgcagcctcattgttactcgcccgggactcgcctatgccgatatgcaatcgtttggtcattttgcgaagcgcccgccttatcaaatgttcccggcggaagtggtggctgagatactgccggagaagaccagtaccataaccaaggcgaagtccagaaagacgacatccgcaaagacgaagtccagaaataaaagggccaagacggactccaaacccaataccacgtctacggtctccgagaccccgtctgtgtctccggtagccaacgcacccgatgctgagaacgactccaaggagggaatggaggagagggcgaaaactccccctctggagcttcggatgccgcggctgaggaagacattctggcggaagtgaacgatatacagtggctggttgttcttccacccatcctatctgtccgtttcctagtagaagccttctctcgatgtgttttacttttttttttcccgggtattgtgtacagatctagtttaatattgctattgtatcgctccagttatattgttacttgatgcttttattttattcattactgagagccgcccagttcatgcttaggggccgtgtgtgtgtgtaatacaagtattgctctactatttgctgatttgtagtaattttgatcgcttaactagtaggatggtagacgatatcaaatggccatctcactcccaatccttcgctggcatgggctctgttccttgatcgggatattgacggctgaaatcatagtcagtacacaagtcccaggcctgcttcagacagtatcgataccgtcaagtcagactgtatccgtgattaatttcgagatctaacaggtcatatcggtcatatcaactcaattctgtgcaagttgaaactctccgtattccactgccctccgtgcagaccagcaaccttaacctactctgatgcatcttcaatggtaggacagacacattcccgtccttttccactatttttttgtctttgtcgtttttctttttctctcttgcctggacctctctggccagcccacggtcgggtttcaagtcccacggcccgtgtttggatcaaggttcattggcttctgtgtcagccacttgtaataatccagttgtgaattagccatcggcaacactgcttccggtccggcatgcttgattgatgagggaaaacacatctagaaccggccagccgccccatcagtatcggagagtttggatctccgctcattgattcctccgaagatagtggggggtggcatgcttttcctcgcaaagttaccatcacctgaatcagggggcggtgttgtggtcgtcaggtctgctacgtgtccgtacactacaccatcaggcacaccacggggtccggcctatgatgatctagacgacgcggtcgggaggtttcatccggaggacaacaagctggctgagaggtacgcactgcagccacaggccaataagtgtgatgcgggacgccaccctcgtaactggtatcgcgggtctcaccgaacggcaagagagtgaggggccaggtagtaccactggtatgaagaaccagctgtgtgaccccggggaagctgtttcccgtgccgacaaggtttggctgatactgcggcgtttgtgctattgcccgtggacattcgtgggtggcttgacttgctcgtgagtgacgatggaccgatcagccgtctcgtctgaggcgaaaccggataggggcaacggtcagcagcactgaggccaaggaggctgttcctctcgtttctcgtatatgtctctgactagaattaggccgcagacaaatgagggtggatgaaggatggatgttctgggagagaggtgaaaagtctgtgacagcgccatcatactgcatcgctctggcttgctgctgatgcaagcgagattcactttcaacctagtacgagctcaatagctccatctccgacagttgtttcctttgtcagaacgggggatcataccggtctcctcatgacgacgtgtcctagtttgatgagagtttctcggtgtgccttcccggctgttcccattgacaccgaggcagcatctatcgatcatgttgagagatccagcaatcccagcttcgccatgagagacattcagagaggggaaagagagaccagcgctagtccttcggggatgaggtagcgaagtgtgatgggggaggaggagaggcgaccgaaggggaaccgacatcatcgaagttgatcaccgtatcctccacacgaagtgaggcttcctccctccctacccccaccccccggctgctacctcacggctgaaaactattagatggacgtgttttaccatttttgccgtgttcatgtcgtgtgtgtgtttcgggggatgaatgtccagtcaatcgacggagatcctccagtcagtcggtggcagatattggggtagatcacgaccgtcagcagaattcgaatggctctctgaactgggcgacctgctccggaaggtcaccgaggggccccttcgcaacctggctagtggcaactagtccatccagtaagtaggtgcaaaccggccgacgcaaggacggggacggcggtttcacatcggttcatcgcggctgatcactcgcaggtttcccccctcgaccccctcccatctctccgcgagttactccccccggctcagcgacgatgatcactgatggaagaaccattcgtccgccaaaatcgacaaagcgcgaaaaaaccatcctcaacgggataaagagagacgagcccaacgtggggcacgcggcctccgtctgtgcctctggctcacggcaatgcaagtgtcacctcgggagaatggcggccctacgcgaccgggaggcgacattcatgtgcaggacatgcgacacggacaagatggccaatccttgtggccgcctgttgcatcagcgggccggacagatgagcgagcgagcgagcgaggcttcggcctggggaagagttcacaggggcgcgggggacagagtgggcctggatgaacccccgggtgcgtcgggggaggtagctctacactgatcggagaggagagagaaacagcttttgccactgaagtcatcatcgatgtgtcgtggcatagcctcaccgtgaataggattatgtagccggtcgttgcctaactatgtatgtagactttgtaccccaggcttggccccccgggaggaggggaaggtcggcagagctacctcgcgaggatgtgggaatttctattagatcatccatggtgggtaagcggatttgataggaagatagatacagcgattatcctcgacatttagtagaagggaaccatatctggagagatacagagatacagtagtatctatcaagatacatacagacatacatactccggttaggggaagagaaggatccaccggcagtggtaccggagccgggccgggttcctttccggtggttggttcgggtttggccatgagaaacacatcgggattagtatggggaagaaagaatgggggagactgaaaggcgaacaagacattctgatccagtagttagttagtatcatggaatatgggaaatggggaagcgaacacgagctaactagcgagccattccccagactctcgggctggctgattcgtcttgatcgatcgatcgcgctctctctctccttccctctctctctctctctttttgctcactgcttgggtcggctcttcacctcaacgttccggggatacccagagccaagccctaacacatttgttctagaaggcgggaagcaaggagctggaaattgagaggtaggccggatggagtagtcgaccggctatctatccagttactactcagactactactcgtgggtagcaaaagaagggtccggctaaccggccaggaaccggatcaacgaccaaaccttctacatactcactcaccttttttgcttatcaaaataaatcaaagggcattatcaccgtctgtgtaaaaaccagtgataataattatgagaatgatgatcaccatacttggccatatcgccatcatttccccagaattgccagccctggccctaaccctactgcctagcattgttccacgtggaggaaagagaaaaagttcgcgaaacggcaatgcaacattttaacactaaacactattcttatttcgtcctgttggttgtgtagtggttatggttgggatcagtactccggagtatatagctaaattgatggcccggtgaaggttaacggccctgtccagactcctgccagatgggggcccgttgttgagtcaaatccttgacaaaagagaccaacaataataaacaatagaaacctcccttcgcttccgctgtccatccattgatttcatgatggattggatagataatcaattgaaaccatttcttcattgcccagaccctgactcagcagcccgcgtctgcatgtcccgttttgaactagtgcacatttgtcttcggttagcttggcactcagagccaatcaaaaataactattggccctgctcctctgtacttagtaaatttcttttcttttttcttttcttttttcttttttttttttcaaaaaaaaaaccttctcgcctttttgtccattttcgtcaattcgcctcgtttctctctctctctcttctacctcgttttcattatccttcttatacatggtatcttccttagggtcattattattccgaacaatgattcatggcttgtgcacaccgtagcactggaaagagcaaccagagataaccagctaagaaatatacacactattaccatcaggtacaccgggctaaaatccaccagcaacggggcatcttggttatgagcatactttttccagtgctcttaacctcgattacatacccatggctcatgcataaccacatcatttgttagctaattaggagtgagttagtagcatttggagatgatgatgtttaatcaggaaacgcctggggtgccccaaactctatccgcttcgctgttgcgaccgtcacctcacgtcaagcagttcaccgtcctagacttctccaggtaacgactttttctttggagtgatcaacgcagttggtggtactcctggggaaaaccagcccggcttcttcagtatgattcgctctgccttcccaactgaaccaccggaccagagcttgccccctccagacagacagacttagtctgcctttaacgtaaggagattgattatcgggctcggggagggctccaccacgctgtggccacgggcgaaactgcatcctcgttttttcttttccttcccccccacaatctgagcaaaatgtagaaaaagcctaaacccgcagcttcttaataattgactatagatacgtactagaatactacggagtactcatctgctagactactctgctactttgctgacttactagtcaagcaaaggccagcccatcctccaccctcccgtcagcccgcccataatacgtatagccctcccccggtgtgtctgcagccctccgctgccgtcaaactttctatctttttttttctccccttccctactctctgccttcctctgatctctctcctcttcttctctttcttcccttctattagtatagcgcctctttcttctttccgcctgacaatttacaaccacctctccgctccgctcccttcttttcgccatggctcccactacccgggatcttgaggctctcaccgtccaccacgactccgacatcatggctgatgatctggccgagaagaaggtctccgctaatgaatcccccccggaaaacgacccttttggcaatgaggagtgtggtgaggtcaagtaccgtgtcatgaaatggtggcactgtggtatatgtaaggttcctcggggcttcccccaaccccaaccccatccaagggtaaagaattaccatctaaaccgaaatgtgatagtgatgattgcggagaatatctccctgggaattctgtccttgccatcggccgtggcgactcttggaatcgtcccgtaagtgcttccactgtcaagtttcactttattccgtaccctctctaacataccccggttcagctccatcttcctcatcctgggcttgtctggcatttcctggtacactggttatgtcatcggccagtttaagctgcgctatccccaagtccacagcatgggtgatgcgggagaaatcctctttggccgcatcggccgcgaaattctcttctttggccaattgctgttctgtatctttttgatgtccagccacattctcaccttcaccgtgctgttcaacaccattaccggtcatggcacctgcaccatcgtcttcggcgtcgtcggtttggttgtcagcttcatcggtgctctgcctcgcaccatgggcaaggtgtattggatgtctctcgcctgtatgtccacgatgtttctcattgttgtttggttttcagaccaagactgaccaccgtctttcattttcgcaacaacagcttgtaccagtatcaccgttgccacgatcgtcaccatggtggccatcgctatgcaagcgcccgatcacgttcaggtcgatatcaccacccatcctagcttctcgactgctttcctgtcagtgaccaacatcgtcttcgccttcagtatgtccctcttcgtcttcccttcttttctcaaagcatccttcctaactcttgttctgcagttgctcacgtggccttcttcggatttgcctcggaaatggaggatcctcgcgacttccccaagtcgctggccatgctgcaggtcacggatacaaccatgtacatcgtcacggccatggtcatctaccgttacgctggtcctgatgttgcttccccggcgctgtcctctgccggtccgctgatgagcaaggttgcctacggccttgccattcctaccgtgagtgtctccccccatgtctttgttcggtaaatttttccatttcgtatactaatatattggttgctcaggtgatcattgccggagttgtgttcggtcatgtcgcgtccaagtacatctacgttcgtgtctggcgcggctccccccagatgcacacgaacagtcttgcggctgtcggatcgtgggtcgccattgcactgggcgtgtgggtaattgcttggatcattgccgagtcaatccccgtgttcaacgatttgttgagtttgatcgtatgcttccctagcccctgagacatgcggtagacttgttgttactaacgggtgttgtgattgcagagttctctcttcggtagttggttcagttgtaagtccaccctctttactctttattttggaccccaggcttacccttccatttcagacggactccctgccatgttctggttggtcatgaaccgtggccagtacactgcctcgcccagaaagatcttcctgaccattgtcaacctggtcatcttcggcattgcctgcgccattgtatgttgtcaacttatccatccccgttctgcaattgcgcattgacactaacctgaccagtgcggcttgggtctctacgtctctggcaaggccatccacgacagctcttcctcggccagctggacgtgcgccaacaatgcctccacttaagggtggatcgagtccttccgagcgaagtcttcacagggtccacctcggcctctctgctaacctcccagatcgagctgggctgttctggggtattcaacgcattggtgttcgtataggtgtttgatgggtcattttcgatgagttccgagaaatggtttttcatgtcatgtttatgttttgtgtctatggttttgtttttcccccactagccggcatccactcgcacctattacctgtttgttcattgcatgtcattatcatcccccttgtgtacagaatgtatatactacctctgctgctgctattactactactacaacatgacgatgactactactctatcctggttggtccactcgcttgcggttgtttctgccgggtggacatggatgcagagatcctcttcggtacattgcatcgcatcatgaagattttggtcttgcatttgggcttgaaaaatagcgcgcaagtcttttgacatatttaggagaatagacttgattacgaaaaagaaattatggactataagaccagaccttgcacattatgtagtgcctgctttcgtcgtggttcatgttttcaacgaccttgtttttggcttcatcctagcggtatctagcacggcaccagtccagccgcacccgatgaacacccgctaacaacaccacgatggctgatctcccaccctgatcctcacagcagcaggcgtccctcggtgctgctccgactggctggtcccgaacgccctgtcggcgccggtcacaaccctaattcgtctgcctgacgggcagttctgctagtggagggtttagggacacattttgggcactagtaagtctgggcaggggcaatggtgatggcggattggaggagtgacttggtgccgcaaccgagtggggagctatctcgttagcttgtctgttatccggaacctcgtgcatgtgagagcattcagagtaaaagctggcggagatacaccctcaccttgaagatcggttcaagttccaaactgcaaggcttcatcgtacgataatgagagaagactcaacctgcaaccccagcataggcgacagattcaaccctccgcagagtgcatgcacatattcaaactcatccccccgtcaaccctcagctccgtctctctgatatccgtgcatgccaagtgcatctcttccgcaacatgccgggtgggtcgctatctcacacaggaaagaactgttcaggtctttaaaaagttcattgtccgacccaggtacatcgctctgcaaagctttcttccccctttttcgcctttggccatgtctcgtcgatttgcagattgacaaagcgtgattactggtcactgcaagagggacaacgttacagctcgcatctccagcgttgcgtcggaagcgcccgtcttttccatcacccctagcttcctgcaccgccaatgaggcgtcgctgcctttggattatccaggcaattgtcctgctgggccttctctctgcattttactatacacatatacagtcccaggcgctttcacagcaagattctgtcccgactgaccctctcgaggttgccattccgcagacagtccaccaactcttcatctcgacaccgggaacccgcggatccagcttcaatccggatagacacagcacctcgtggctccaatcaggatggaaggtcgagtactggagggagtcgtcgtgtctcgaacttgcacacgagctcgatgatactgggtcatacgccgccacatttcaggccctacccgtcccgattctgaaatctgacttttgtcgctacctgattttattcgggcggggtgggatctacaatgacctcgatgtccacctcctccagccgctgccgtggccagtaatgggcccagtcaaggatggggatgaagaacccccggctgttattgtcggtctggaaggcgatgccgccacaactggcctgccccgatctccgcaatttgttcagtggaccatggcatctgttcccggtcaccccatctttcgggacgtgctgcagtccattgtagaccgcacaggtcactatgcctcgactcagactgcagaagctgaggcggacattgacgtgatgagctggactggtcccagtgtgtggacagatgcggtactgggctatctacactccgatgatgagcagattcaacaactccgcgatcttcacgagatcgtgcgcatgcatgacgtggtcatccttccgcgacgatcttttgcggtgctccagggtgaagaccagtctgcaccagacgttctggtcaagcattatttctcgggaagttggaaggcgtgtgctcgagaatggctccgctggctatggccgggaggttgttgactgctgcaggtcgaaagaaccgctggaagtaatgattcgattggtttgggagtacttcaattacattcgtattttatacaatcgtctcgctcgtcataacagatggtggccggacatattcggagtgggaagccgtagtgggttcgctttctccagatattcggggcaacagaacatggcctttatattccttccccgtaacgagatcagccgatcagaacatctgatcggacacatccagccctcgatcaagttcatccgcctctttgcgcaagacctccgcccggaactttcgaaatgccgtctcgattctctgtcttcgatcgggatccgccgtgatgcagcgacttccacttcctgctcctcccaagaagcctacaaaagagtgatacttagcagatgcctactaaaacacggtctttcaaagcgtgcaggcgcataaacctaccgagttcgccgcctaggaagaatcctcccgcgctcgcaaagaaataagtagcgaaatcacccagggtggtgggtttcagcagtggagtgatatctggaatcggctctggtttgccacggggttagcgtacagcatttgagcaggaggagcactagactcaatgaatctaccagagcgaccgccggcaaagacaacgtgggtgggcttttcgcgggcgcggaagacctcgaagaaagccttgcgtgaacttctcagacggaaggcagcgtagagacccagaccgagtcctacggctgagccaattgtcgtccaccaggcgaccttttgtgtggctgtggtgagagcgtcgcggtcttcagcgcgcaggtcatgctgcagatgctcctccgccagacgggcgagctcgttgctgcggcgattgcggagagcgggataaaagtcgggcatggtgacagtgagataggtaattataaagagagtattacaactagtaatggagcatacagagagcattgacaagggatgagggtagtattcgccgagtttatataaggatggatgagggcgtagacaaaagcagggcgcggggcaggacacatgatgacgtcatgaaccggggttttgttcatgatcaggtactactactacgtatggcatattgtttgtctgggctccgtagtagattgagatgaagtactactactctactcagatgactgtgtgccttagtggacttagtaactactactggggtgagggattgaattcagctgaacagtgtaagtggaagcaggggaactaacatttgtatagtatatatctttatcctatcatccaacgatcgactgcggaggggacttcacgagagtgtcacaatcttagtatgatatttggaggtttatttttggcttctccttctgagtttctagtcgccaggtaacgctctatcgcgagcaattactacgggcgtactcatgatccatcagaaataatgactacgagtgactacataagtaactagatagtatagccattcaggcaatcaggccataaggcaccaagacaccaaggcaccagagcggtggggacctgctgccggtcccgtgaccccgcgtccaagtaattaattaaagtaaattaaacaaagttgatcaatcaattatacttcgacgcgacgcgtttcttgatcttcacttttcaccgtctttctggctggcagtccaggtagttagtgggactaagcttgcttttcttctctgacctggtgccaatgcttcgatcctgattgaccttcctctccaatctccattgttccttccatctttcatctgctcgtcctgtttccagctccttaaacaccatggttcacattcaagacctccctcgggagctgcttctgcatattttctcctctgttgcccacagcgatccttccaacccactggatcagaacaccaagtcttccgatgaaaacgtcaagactcaaacccaacaacctcctgccgatagactgttcccacgccctccttgggtcgctgaggataaagatgatgagaccgatgaggagaatcccgaggatgattgggagggagggagcacacagatccaggacgtgatcgacgtgtacaatctgtgtcgggtgtgccgcttattccgcgacctcgcccagcccctgctgttcgagcatgttgatctgtctggcttccctggtgacatgcggaacctcgttcttcttacccgcaccgtcctttgccgtcccagcctaggcgaacatatccgcagcctctccgtccttccagaccacgatcatcacgtctttggtaaaagcccaaagcccctgaccgccgacgaccgaaagctctttagctcctccatacgcgatatcggcttagccaaggaggacgagcgcgactggatgagtgctttgaagaaggaggaactcgactacagtcttatggtcctcttgctcatcttgaaagctccaaatctccgcttgttgacagtggcgggaggttactttgccatgaagccactcgaacaactctggaagcgccatcccgccgtattgtcaaaactcgaggacctgtggtttgagggtgacgatctcctcaagggctatccgcttactatttacgaggagatgatcagtcggcctcagctacgctcgttaaatattgaagaagcccacctcagtgacgacctatttcccgcctgttggactccacaatcgttaaccacgagccggatcagcctacgcctctgccacatcgatgccccctctgtcaccaagttacttcgcgcatgccgcacagtgactcacttcatctacgacaactttaccatcgaccctgaggaccagcctcataacctccgccccgttcgcgaagccaccgctcccgagttatgcgccgcgctcctcccccacaaggacaccctagaatgcctgacagtgaccttcaaccgcgaaccccaggaacgagagaacatcgatgattacgtggcccgccaggcgaagatcggcccgctgcgcgacttctccgtgctccggcgactcaccgttcagcaagcgttcctgccgctgcagccccagttccctcccaccctcgaacagctcactgtcgacgactgcaacgtctccgtccgtgggttggccgagcatctggctaaggaacatcgacagggacgccttcccgcactcaagcgcgtcgaaatgctcgccgtggatattaccgaccccatcaaacttccgggtcagcagatcccatttggccagacgccggagcagtcttacacaagcattaaggatctgttcaaggacacgtccgtcgatttcaccatcactccttatccggattgtccgcagaacctcgcgggcgactccgacctcgacgactactctgatgatgacccttacgatatgacagatgaatatggcttactgggtctccgcgaagggggtaacagcctcttccaggcgatgctcatgcaagcgatgcgggcacaggaggaccattacatggatgatgagttcgacgagtgaaacagatgaccgagcgagttgatgacgaagatcacgagtaatttgggaaatgtatcacgatcataatatctctatttaactaggctggatctagaccttgttggaatctcatactttcgggttgttgatggacactgctacgggccatgggaagtcccgcacgtattttttcgggaataaatcatgattcgctggcaatgaacttttctttcgtggaagagcaaacttttccggggcgatactatcgtggaagccggacagagccagccagtcttgttccttcaggagcaaccatacatgccacacaattcactggccgcaaaacccacctcagcctccatatacacatcgaccgcatcactgtcatcatcatgacaatctgtcgacacgaagatagcatcagtagtatcttcgttgtcctgattccaaaaataatccttcgagacctcgaggccgcggagatccgaaaacggagacagaggatcaacctgagcaatccccaacgtcacagctatccccccatgaattcgcttatgcgcctgataccccctgaaatgcagctaataccagtacccgccgaagccgggataggtgtagccgcctagattggtggttagccaactgcccccgttcgtctgtgtgctgccctgcggatcccagaggaagaacttgctgccatcgcggaccgtgtaattccactctacatctgcgtgaattgggaatgaccgtgtgtcccacacttggaaggttcgtcgcccgcttccgaacttgtagtaactgtatacgccgccgtctgagccgagtgacttgccgctattattgtctttgatgtagtagcattcgccgtagtgtatatctaggctgctgctggttggcccttcctcattgtccgagggcgtactcaacatcgatcttgtcagaggcgtaaggtcagacagggcagggtaagagtgaccggcggtcgcaataaactcggctggagggctggatgaccacagacctgcttgaagagtgccgtggtcgtaaggacggtcaaggctcaggccaagcaactagacatgctgggtaggtgtggatgcaggctgcagtgtagctgctttaagtacagaggtgtctggagggcacaaacacccagaggttatggtggatcccgtgataagcacatgcttatatacccagttaagtctttcgcaccctgctgcgaacatggccagtgagccgtagcgtcacactattctctggaaggccgcggatgatatgaaggttatcttctattgatggacgtacttacagccctttggggagaggttcgtcatagtgtagcgagactatcgtgggcgagatataaaggcaaaacatacattagggagctacatgtactggccaatgccggtgcagggccgagaatggctgggttggttaggcaggtcggggctgttctgttgacaatgggactacgatgggtgaaccgaaaggtttaaacctaataccctggacttcagtcctgagtctgacatgcccgccatccgataccgacgagaaggcttccaagaaaagctctgcggccattgtgggcaggctagcctcaggccgactccacgatataaagctgacgatctgctctcaacgtcgtctctgcggccttgcgagaccttttgtcggtgtgatcaccatcatatctagagtggctatacctgaccgttagctggcggtcaatttaaccgtacagttaacagtcatatatattttcattaacctgatggtcccagacataataattcagctattttatcacagattttctgtagaatttccggaccttttattatttcttagagttacctatcattacaaccagtaagtttaggtgtattcgcttatatggttactacgaatctcttcctctatacattcctggcagcgtcgaaagacggttaaaataaaaagtggtcgatcataataaacaacgtcagtaatagtagaatctcgtatattatcaatcacccgaaatcctaattctttcctccatatgatggtgattcctttatgggttgaactcgaacaaaccttccaatggagatctagcacagctactataatgaaactccaaaccagttgaatgtctcaaacagacttttcatagatctcgcagtgttttaagctgtgagagacatagattaattttcgatacaagggtgctcttgttcgcacacgaggctggggtctcttgatcgcgtccttgttgaggccctttatggcgagcagtatcgcaattaccccctgttgttcttctgccgtagcccatgagaacggtatgattccttcaaaataattaaagtctaaattgactcctttcaccgcgagtagcaatttgatcacatctgtcaatcccctccctgccgtcagcgaaaatggcggtcgtccgtcatcatcccttgaccctgggtcaggcccgttcatgagcagtagcttaagtatccgcctcgtcgcctttgcctgcggcccagcatactgaagcttcccctcatgaatttttaatgtccggatcaatactctcatgttccagtagtaaacctagccccaggagggcggatgacgaggagagttcaagaagcgtatttcagtgcgtttggatacgaaaaaggcttcagtttagacgcaagaccctggggcttctgcaaacgtgatatactcacttgcttcttccaaccacataagcgccagcggcttctgcaatctgagaagctgtgagttcttttctgaataacatatcatggatgagatcgacaaatggtgcattagcactgtaggcatcgggaacggagaaggtcacttcccgaatccaggcatgacatgggaagattaaggcatgggatgcggtgctcattatattaatagcatctttgcatagtccatatttatcaaatacaccaagaaattctcaacgcgcaaattgttgtattctctatctagatgcgaaccgcagcaacacggtgactcctggctctgcccaatcactgactaatctacacatccgctctcagcatcgaaatcaatgtaggtcccttttcgttcgagattatcctcctaatcagcagtctgattaacaacttcaataacaactttgccaacctgctgtccgctctccagtatttgataagcctccttgtattccgcaaaggagtacacctgatcaataaccggcctcgtctcatgtcttgccatcgccgcaagcattgcctcaaaatctagtcgtgacccgataattgatccagtcaacgtcagggtccgagccatgatatcaataggcgggataccgccaccaagaccacttgcaaagccgattagaataattacaccacctatcttggtgcatgccgcggctttctgaatagtcttctctccagcaatatcaagggtcctgtccacccccttgccatcagttaaagtcaagatctcgcgatcccagtctggagaagtgttgtagtttactacagcatctgcaccgagtgccttcagcctagcagctttggtatcagacgaggtaatagccagcacacgagcgccatagattttcgcaatctgtagcgcgaatagtgaaacgcccccggttccttgaatcagtaccgtctggccaggctgaagaggctcaattttattcagtgctgtccacgctgttactgctgcacagggaagcgaagcagcttcagcataggacatataatcgggaatgtgtacaagtgcatcttcatgaaagagcacgtactctgcgagcattccatcgatgctaaacccagcgctcgtgcgaaaatattctggaataaatgggccgccaatccaggttgtaaaacaaccgactgcaacccgatcattgggtttaacccgttttactcctggcccgaccgcgataacctcgccggcgccgtcggaaacaggaatcacctcctccttgctattgacaggaaagtcgcctcgcagtagcactgcatctcggtagttgagtgagacggcgtgaacccggatcaaaacttcgtgttgacctgggctgggcaaaggttcctcacgaagctcggtcataagcttattacctcctgcggtaacagcgcggactgctttcatttgctgcatgggtggcggataataaaatgaactcgtttaggttcgattcgatcggtaaattgactgtgagtgaaaagactgtctgattcgtaagtatcagaatcctgcatgggaaaaagaaatgatatataaaccttttcttgtaaagctccagattgtgttcttcagacagcagaggacatccagtgcagatggtatttgatacttgtcgtagcgtatttataatgatatgttgacaaatctataccagcgagcaggcttttggcttggtgggctctcctgaggtcgcacatatcagttaataattgcattagagtgttaataatatggtaaagaaaaatatacaagcaaggcgggcctttcggtcggtgacgggtactaactaggctctccaaggtgggcactccgaggtcgacatcattttgatgcgggaagtcaacaggcaggcttttggtggaaggaattcattaaactgcgtggcatattcgtgtcataccattacatacgccatatttccacacaagaatcccgcaccccgcaaccctactaacaaccgatcaactcggttatggacatatatccaacaaccacggctccgccaaaaggagcatcttcgccgccatgaagcgcaacaccaacagaagcgtctccgttgccacagcctgcgatcgtgagtttgggcaaaggtacgttgtggttctttaatcaggtcagtgggatgagtgaccctgacaatccaccttagtgatgtacttcgacaacacatgtgacgagtgcatgggaaaaggaacatatcacaaagaatactcatgccgatatcagccatgttacagaatctagttattataagatatcatataatttataaactacttataaactctgtcgggcgttgagattaaaggatgacacttgcgagattgtagcatcccattcccaggccgcccggagagaggtttgtgcatgggtggtggatagcccatgaatctgctcggtcttgagcaaaatgtcaaacagggcctcttgctcccttctatcagtcatgcgatcaccacctgaaacaacaggatcagccaggatatttttgccataggggagaaaagatagcatacacatggatactcccatacaggcagcaacgagggccggagcggttttgttagagatggctatcccacaaagactgaagacatggtgcttgacctcggcctatcgtagttagcgatcagactcaactgcacgcgaagttgtacatctgatacctctcttcgtgcaacggctgccttgcgaccaggcccaaggcgaggcaccgtgggatcaaacaccgtcagaagaagacgtgcgaggtggcaatgctgaataccagtgactgtgagcttggtcagcattgattgatcttctcttctaaggagtctagtcttaccgatgcagtcatccaaataccacaaaacgggaaaaatctcccccttgacggtatttggaggtcgacaatacaaggggtcaaaggtaggcggagttagagcttgccattgctggttgtaggcacacaactcctcgtatcgcccccgggtctgaccttcctcaccatagcaataccggagcacatcgacacagtgcaacaccactcgattcgcccaggtgggatcgtccgcggaatccaactggcgatagacagacgcttcacagcaactgagatcgagcttggcgactcgctgttcgaggaaggccttgtgaaactcctgtcggatgccaacccagaaggccgctagttgcagtccgccacagcacaatgcagcgtggccctgagcgttgaggaagacttgggtgccacgcagatgagttttcccgtcactgccaactagggccgctgtgactcatgcctgtcagcaatttaaacatagattgcaggtaaacgaacccgactaaccgtcgaattcctcataaaaacgcaggatgacagacgccgccaggaggtccacgttgtgaatctcggcgtcatctgctgacaccaaatgggaaatgcagagagactggtaatcgagggccatgccatccccaagattgggtagacgtctccccgcaaaggcgaccgggcgggtccccgtggactgccagcgaccgagatgtcgtgcagctgccgagtagacagcgtagagcaaggccggacactgggctgcgcgatccggcattacaagggcaaaatgcttaccagcatcgcaggaatcgaactgcatccgacattctcaggggtcgtgttgctgatgagggttgagggaatagactttacccatggggccagctcctcaacgaagtagcgcatcaggcatgcctcctgcacggcccgatcagtccatatcgacggttcggctggatgtggagaatttcctatcaggctgtcattatcccgggtggaatctggcaagctcagcactgacatggttgaatatgggggatgttgatccttgtcagatcgcagagggtaactggcggggttatgcggggtgagatcacgggacgacgatccccccaccaggatgacatttacagctagaatttcttgtttgaaccactctctatattgtctatcatgtatcgttgatatatctatggtctataagctcccgccgtcacatttacaatcgggaagagctcttcaacttagcctccaacctctgaccaatctgcggctccacccggctgaacatggcaattgtggccttctggatctccggcaccactccctccaaggcttccgccacgttgttcacccagaggctgcgctccgcctcatcgaacacattgttccacaaggcacggggctgcacaaagtcctcgtcgtccacggggatctcgttgagacccagcaccgcgccggagcgcagccactcgtggtggcgcacctcctgcaccgactggctgaacacgccaggggtcagggtgctcttgatgtagttcgggtcgccaccgtagttgcggcccatggtggccagaccgtcacgctcgtaaggcgcatacacggggcagatggcccggttgggcggcagctgcgtgtagttgactcccagacggtagcgctgggcatcggggtaggcgaacatacgcgcttgaagcactacaggaggttagtacgattccttatctacacaaacgtatggggaaagcttactaggatcaggggtcacggcgatacccggcaccagattggagggcgagaaggcggcctgctcgatctcggcgaagaagttctcgggctaatcatctatcattagcacgtcggcactaacatgaaattattggctgctagggggaagactactcacgttgcggttgagggtcatctcgccgacctcgatgagagggaagtccttgtgcgaccagaccttggtgatatcaaagacggcgcggccgtaggtctcggcctgctcgggctccatcacctggatgtagaacttccacttggggtagtcaccacgcaggatggcctggaagaggtcctcgttgtggaagtcggggttgacaccagccatgcgagtggcctcctcaggggtgaagttgtgggagcccaggacaggtttaaagtggaacttgcagtagcggaacttgccgtcgtggcccaccagcttgaaggtgtgaataccgaagccggtcatgcggcgtgcggactggggcagaccacgcgagccgaagacgtgcatcagggtgtggacactctcgggctggttgctgtggaaatcccagtactagatacccagttaattcgacaggggtccacagtcatcatgatgatgaaaagatgaacttaccatgttcatgtcgggaagaccggtggtagggtgcctcttgtgactgcggttcagggaggggaagcgaacggggtcacgaacgaagaagacgggctatcacacaggtgaggcgatgtctcaaagaggtacacgggaaacgagtcaacttaccacatggttgccgacaatgtcgtggttaccctcctcggtgaagaacttgacggagaagccgtgcacatcacgcacggtatctgcgctacccttctcaccaccggtggtactggcgcggaaaagcaccttggtggtcttgccaactccgttgaggaacttggcgtgggtgaggtgggagatgtccttggtgacgcggaactcaccccaggcaccattacccttggcgtgaacaactctgttgaatgaattgataaggttagcggacgaaagtgccgatgagcggtgggtcagccggaagggcggccgtacctctccggaatccgctcccggttgaaatgggtcaacgtctcgatcagcaaggtgtcacccaaggtggtgatggcaccgccgccaaaggtcggcagggtggtgctgacagaggggttgggcagaggttgacctgcaggaacactgtgagatgggaagttggactggtgagagagaggatacgtgtcacctaccctcggcaagggtgtaaacgggcttggacatgatgatggacgtgagattaaagtttccgggaataagggaggatgcgctagtaaagctatccgcgaggaggatccaaagggggtcaaagaagatgtccacagagccggctctgagggatggggtttgcggtgcacacgagaagaggaagaaaagagtcgatggagacagaaataagaaaacacatcctgacgctgaaaaccccccaagataaaatttttccctcccggccgccctttagcgccaaaagtggatgaggccgtatctaggacccgacggttggtgacagctcgacacccgctgggccagatctaactgctaacagtataaattagataactcggaccaagtttaaccagtttagggcttgtcccctcatgaggggtgaggggatcgtcggcccgtgaggggtttcttttgcgtaagtcctctttcccgtccttcctattggttgatgctccagagcctctcccgcagtcacatgacacttatcatgcacgcctggcgactatccgaggaactgccgagaaataataagctaaagatagggaaactggaagataagaaagtcgagacacagtgacaagccaaccagcttaatatgattccaaacattggaaccatattccttatatgataggcaaagaccaccagtaatatttacctaacttaacggcctgtgtgcggagaactccttaaagtttaagcagcagagttcaagacatattactactatcttctgaggtgaacaataggcatgtagtagtagccgtagtaagtactattctaatatgcatttaccggccacattcgtttcatatattgcggagacagataattcttcattattatttgtggtctgtcaatcaatttaacatctagggcaaaaggcatgagtcagattgatgcgctgtaataactaactatcgggtatcgggcgatgtcagcatagcgcagagagttacgcgaaattaccttctctttaccagccttaacacgttggacaatatcaaaaagtcatggaagggtcagcggtgcgtagggccctggttaaggccgagtccgccttttctgacaagcttagtagcctgctgccggctacagcatcctggtaagatcaatggagaattaggctatggccagtatgatgatggatggtagaagacgatgcgaaggtctcgtgtttgatgagaaaagggtaaccccaggattaacggaaggttgtacgcgacctgtacctgacacgtttggggaatgcgaaacatgtttctgtagcccataaagtcatgtcacttggaccaacaagaggcatgtcaaggatagagcatgctgccaagcagagtcgtctcctctacttcattttcccaaggcgtgtacattggtgcgcccaaggaggcactttgaagatgttgacaggccaatttggtgctggaatagacagagctttgagttgaagagtagcttaatcgccatcatccgactttgcaaaagcatgaagtcaacgatatgggtatgcttgcatgtaacgcccttggcatatgggaacccgaaaccgataaagcactagacaggaagaatgactctgtccccccaattgtacgctagagatacacatatgcccatgaaaaggtttactgctaagccaaatcgtaggaggacttgccgcaaaggatcatcactggtatcgacaggcgaaccgtggatgatgcaatattacccagatgaacctcaaagatcatataaggccaaacaaaattagcgcttatccccctattttctaaaagtcgatggacgcatacaaattatgtctagcaaccttcgcaatgatgtcgggttggtgttccatctccagtgacgcaaagaggaccttttgtgccgaagcgcctcggctccaccccacggggacgggaacgaggatcaccaagaggtgtaaccaatacccaaatgagtagggaaggagcggcagaacttttgaatgatggtatgggttaggacttcgtaaaaatatatcgcggtgaaagcagcctataaaattcggattctgtgacgggactacctgtggaaagtgttcccaaacccaaaatctacgaaagcaagtgccatatcaagggctaccatgccctccagctgagaccgacggccttactcctcataccatactccatcgtcgatgaactagctggcgatggtaatgcacttgcctatactcggacttctggccgacttccgagggctgttgcggtccgccgagtggagccgatagagttgtatggacattacttaccgtggctatccatcttataagcaagccattacccgatgaaaattatagatgtctccccgtactctttgttaccttgatcaaatagttaatttgacttcatcatgacgatccgatacttgaaaagcaagtctcaatcccccaactcagctgcgacacctcaggtggacgtgagtagcgtcgtaaagggggtaatcgacgacgtccgtgccaatggcgatgcagcagtccgtaaatactcagagaaatttgatcgctggtcgccagcttcgttcaatctctctcaagctgacatagatgctgccctggcggcctgttcgccccaaacgattgccgatatcaaggaggtgcagaagaacgttcgtgcctttgcacaggcccagagagactccatccgcgacttcgagtatgagattcagccggtaagcccgttcagtttaggagagccacgaggctttatgcctgcgaagagccaactgaccagtccaagggagtgcacctgggccagaaaaaccttcccatcaacagcgttggagcgtacgtgataagccaaattctacccattaacctaatactcatcgatgacactaggtacatccccggaggacgctacccgctgctagcatccgcccatatgactattctgacggccaaggtggctggcgtgcctcatgtggttggctgcactcccccgattgccggccagatcccccatgccacggtggccgcgatgcatctggctggagcggatgagatccacctgctcggcggagttcaggcgatcgcggcgatggcggtgggcacggagaccatccgaaaagtggacttcctcgcgggaccggggaatgcatttgtcgcggaggggaagcggcagttgttcggcgaggtgggcatcgacctcttcgcaggcccgacggagatcctgatcgtcgccgatgagacggccgatccattcacggtagcgaccgaccttctgtcacaagctgaacatgggccggattcgcctgctgtgctcatcacgacctcggagcgcgtggggcgggcggccatcgacatcatcaatcagctgcttccaaatctgtccacgcgcgagctggcgggcacatcgtgggatcggttcggggaagccatcctggtggactcccttgacgaggcgtggcgactggcggatgagtatgcgagtgaacatgtgcagatcttcaccaagcggcctcgcgaggcactagagaagatgacggcgtatggagcactcttcctgggggaaaagacatgcgtgtcatatggcgataaggtctggattccgccataggaaagcttacttgaaaatttggaaggctgcttctaacgtatattatcttctaaacaggtcatcggcacgaaccatgtcctacccaccaaaaaggcagcacggtatacagggggcctctgggtggggaagtatctgcgcacggtgacttaccaggaggtgacgagcagcaccgccagtggggagctgggtcggttgtgtggtcgagctgcaagggcggagcagttcgagggccatgcgcgctcgggagatctacgggcccagaagtacctgggggatagatatgactggattgcctcgtctgatcaagccaatctgtgagaggtgtttgtgggtaacctcgacggccaagagccgtcttcgtgcactggccctcttgaagggtaatcacgtaaatagtgagcgtcagataaatggagtggagataatagtgaaaacaaatgggttgaggatgattattcattgatctatctatgagctgtgactctaggaagtccttttgtactggatagtagtgttgagaataagcgataaagtgactgattgagaagcatgattagtcatgttatgcatgtatccccgaaactcggcccgagagagccaatcgccgacccccaattgttgacccagttttgatggccggcaccggcgatccatcgaaaaacgcaccgtcggtgaacgtgaatagagaggtccaagagaggaaacccgtctacaagatacacgattaataaaacataccctggaagtcgactgtttgaatgtgctgcaagcaaacagtgtgctataaagtatcacacctccaataaccccttggagagcaccgccgtggggaatccctccaacgatgacggcacaacgatcgtctctcctaccagcggatatgatagagtcccagctggctatcattgatcttctcacggccatgtttccgggcccgggcgagctggacctgcccgagtctacatcgcaatgtgtggatcaactacgggactggtgtcaagatccatcgaccgtgccgtcgggaatccctgccagcctcttgctgggggtgtgtttgcccctggaggacggcgggaagacaatccaggtcaatgtctccattcccttgcacagtgagggtcctgcactagatcagccacccccggcgaagtatacactgcgccaaccagactggatgtccaaggccgaggtcgctgcgctggccgctacgatgccacaggacgacgtctttacggccttggaccatgttcgtgaggaagcgacgcggttcttagaagcccagccaacacagccggtggatctctcaccgagtcagtcagggtcaggacctctggtgcgggtttggttctacttcccttccctatccacgcgcaagaagcgggatgatctggtgcatcacgcggcaggttatgggctcacgggatttgtattggcgggcaaaccaggcgtgttgtgcctggaggggacatcgcagaatatcgatgcgtacatgagtttcatcaaaacccattcctggggggatattcccagtcatcagaaaaaagttagcgaacgatttcgcgagacggaaggggtgcagcgggtatttgaggggatggaggagatcacggattccctgggagaacgcagcgggcagcgagccaaccggggggatatgcaggccttggaggcgtggctacaggcccgcggattgcagcatgcctttgagcaagtgatcttctagacataaaaccataaatgtaattacaattatcaaattactgacctccattatcgtgcgtctctgtgtaagcagccagccagccgccgtcgtagccatatgcttcccttccctcggccttgaaagccgatagtattgtccaataagcacgattaccttgtcagttgtaatcgatcttgttttctttctgctatctctacacccgcataacattatggacctccccggccctctcccgccgtcgcatcgcggcctgcgtgacatgccgcaagcagatggtacagcatctttaccatcttgacctttcacctccatattgaattccttccaatacaataacattatgtaccaaataaaataatccatagatggaatttcaaacgaccaatcgccagatttcgtgcgcccggtgtcggaagcgtagcttgccctgcaccgccatccgcagtctccaaaggttgctcgcggacgatgctgtatctagtgtggacattccaccccagcgagatagacatatgatattgactgaatcatctcatggagaactatccactatatggtatcatgccgctactcattgtgttccgcactcaagaatcaatagggaaaaaaggtgcatccatagcgcaagtaatcaatcatggtgctaccactcgtccgagggcaggtcggacaccagtatttccgctcttgacctcaaaacgactgtaatgggatatttgaattatctcagaattatctcagattctatataagatgatcatgacatcttcaatatagcagcgcaaaaagaaaatggaacaaacaaacagtttgggtatcctcgtatgcatatgcctcgtcgccacaacaccaccatcattcctcaacgatgacctgtagattcggtacacacttgcagcagcgccttcaatgccgtcccaatatccgaaccattgtaagatataccgactatatcgcttgcttttccacctgtgtctgggagatcctcgtaaacacaactctctaattcaaacatgttcttgtgctctggaggcaagttctgcatcggcgtgaaacacaacataccagcaggtccatggatcatgctcaagtcaatggtagtcagacagggaaataggtcacgatgctgacagaggtacgttaaccactgtggcgtcaagctcgtcactgaccgcagactaagcttcttcagatttgttcgcgagttgcagagaagtcggatgaggtcttcagcgtgcatcgaggttccccagatgctgatccgttccaggtggttcagagctgcaatggacgcactcaactgtgaaaagaattcgacggcgagatcggtgtatccgaggccaagatgcagtttgcggagaccagtcgcactgaggatcatgtccatcaggaacgtgtaattctggggggtcagttcctgctctaggtgcaggttctccaaggacttccagcccgtctggaaggcgggattgctgtagagtgactttgggagacgcgcaatgtccatcactttggaggtgtagttcatgcccttgccataccaaaagagtttaaccggaagagaagcgtccgcgatgaggtcaaggaggatgcacgcgacatcgtcggggttgaaggtcgggctttcgtggaggtccgccttactttggggttctgacaaaatgggcgataggatgaaagatcggcagtttaccaatttttgtgtcagatcatctcgcagccgccggatcaagggcatgtctaggggacatcggaggtgaccagcagccgtccagtgccagtccatattctcccccagtctcggctccggactcaggatcaccaggtgttgaatatagcctcgtatcagctggttttcggccagcgcatgcaagtggtttaaagagtgcgcggagaagtctgtgtagtactccgcgtaccgctgcgcaaaacaccggttggtgagatgatgagcggcgcggcaagtccctcggagcgcggccaaatcttgcgttgcaagctcgtggcaaatcttctcaaccatttccaatggaagagaagataaacgggaaggcttgcacataatctgctctgaaatagactctaacattgtgttaatttctcgggctacaaggagaaagggccacggccaggcgcggtcgcgtatgctttataaggagcgagatggatgcaacagggtccttggaagtaccttggaggcacacggcgatcattgaagcgtcacaaccaccatctaccttgaccccacacccataagagaaatagcgtcatcttcgcgtgggagttgtaattgcggctatgaaattagcacaagacccaagggataagtcactccagaggtgcatagcgatactttccctggaatccccgacataccatgtggttcagcatcgagcctgccagcacttcacaaacaactccctatcagcaaagatgtattcagtatcactaccagtaatctgataatatgatggagctccagcaatagatgggcataatcgccaatcgctggcttgtttcatccacacaatgaaattgcggcctcaggcagcaaccaaagttgacgatcctgatacgagatatcctagggtgccgtccccacagaccatacttgcattgattttcactatcagtcgaccattagagatctctaaggaaggtggttcaacctaggacttgccattttaatgttatgttagggtgatggtggtaggtaagagagacggcaatactcccgtgggtgccatggcaggacacgggcaatgacaatgacagcgatggggaatcgcaaaatggctgtagtttcactccgatgtcattcgtggggatgcaaaagccctcatatcgtgcgtatgcaagttataccagcatccgtcagatgttgatggagctgtgccccgttcttgagctaacgtctcctgcgtgggtcatggtgagtgatcgcagcagcgcccacaagttccaggtttgtctaacccagatcccccagcagaaagcacggcctcaatcgcttacctgtgacactaagtctatcccgaacaaaggtggagtcactagcgtggtgcgtcccagtgaagcgtggtggctgatgcaacattggagcggtatcaaccacaacctgatttgtccaggaggctaatctccaggataaaaatgtgataattatgggccctttcaccctgagtaaacgtagtgactggagaaccggaaatcactttgtgatattttggttaaacacaattactacatcccaatcttggggccgaaggtgttgcaaagttgcaggaaggagatgtataagaactagatacagaggctgtgcatatgagcaggaggggctattgaagctttgttccttgtccctcatcgatcttaagccaataacgggtgacactgtcatgctctggaactgttcgctttcggctggcctgagctactattctcacccttcccaaagtcgtccaatggcgacaattcatagagaacatcacatatttcgtcttcctcctccaaagctgctagatcaagcggcttactaccttgcgcgtcttccacgccggggtttgcgccatgctttaggagccacttcacggccagtagattcccttggtagctggccgcatgaaggggagtgccaccgaaatgtaggaatgcgggatagccgaattcatttacgtcggccccacgttgtatcaggtgctccatcattggaatggccagtccgcctctcctacatgcagcataatgtaggacattactgttgtggatgttggctccatgatcaagaaggaggtcaacaatctctgggctacttcgacgggatgccatgccaaggactgcccctgagcccttcgtaggagactgatcaggcttctcaaggtcattgaatgactgggcattcgggcagccgaaggtggggtcggcatcttgttccaggcaccagtgaacgagccgttggtcgttcttctttacaatgtgtctgttcctttggttagtctgtgtgaacaacaacaggcaagcaaagggatacccacacaagaggcactgtacctagagggtgtaactgagtctcaaaagtaagaccgttgtctagcaaagccttgactgcctcagccgagtgtacttcatccacgacagtgggagactggggtttggcgcctgcatatagtagatagcgcatagtttcgatatgatcgccctgggcagctttcctcaagcccaaggtcagaacctcttggtctagagtcttagccttctgatgtttcttgacttgggccaagtcaccgtgacggcagctctccagaaaggcctgattagtctcctctactacctgaaatggaagtgacattatgggtgatgaaacaagtggaactgattcttggaagggtggtgagaatggttgaggtattgaggctttgtttatgttgtattgatgagcgccggccgatgaagggccggggggcggtggatgttgctgtggagaagctaggcgtgggggctgcggcggctggagacattcaaaaccaggattctggattatctggcctccgatgcagatctagaggacgagcgcttaaatgggtcgtccaagtatccgagccccgacaccaagggtcacatcggaaacccgttagcgcggacgggtaaacaggcaccacggtatccagagcaagtgaagcgcatcgctgcgcaggtcagctcggttctgggattgtcagcagaaccgacggaatatggctacgagacgatcaagcccaaagatgacagcgacgaggccaggagcagcgacctaacctatggtgagggtaaatttctcttccaatatggcggcagctgtgcgagtcccacctggcaggtctgatatgggggcaaggtcagtggccccctttgggaagcttcgcaagtcagtgcgcagaagcggccggattcgtgctctctgttgtctttggctgctcacgccacttccacggccaagccctgagcggttccacaccttccactgtgcttgaccctgctgttgaagcatccgagggggatggtataagaaagatagccagccgatcgtgttgtatcacattgactgtattatagtatcttagtactagtgtaaaattgtcacccttcacactcgacactatacagttcatatttgtacttagctagtgatcctttgcaccatatgacgcttctctcctagtaggagaggaaatagaagtcaggaacgcaacgaagacaattaactaatggagtggggcgatgctgcataaaagggacagcaccgagacagccgatgcgccgtgatgattccattggtggactccatgcagttctgaagggcacagacactataaatactacctccaatcgtcgtggctcacggaccctttggcggggcacgtcacaactgccgggggctgaattggaacagtgtcatccttgccatctcacgtcgtgaccttgtggttttacgcaagactaccgtcgccagaatgattgccaacctagccatcgcagtggtcttcagcattggtgtgataaccctgctatatatgatcacctcgcctcagcccaacagaggagcagcaactgatgagaagcgaccacctctcaaactcccgctgatcggggatcttcacagctctccgatcgataagcccctcgccaactgggacgactgggcgcgacaaaatgggcccatcaccgtttctagattatttggcatcgtcccagtcgtgatacttaactcttacgaggcggccacagaattattcagtcgccgcagccagtggtatagcaaccggccgcgttcggcgacaatggagatgatcaccggagcaaagcccggacagtctcgattcactttgatgcacgactacgacgattacctcaggctgcatcacagattactcgctcccagtctcggggccctcgcggcgccgaggtatcagccgttaatggaactagagaacaaccagttgctctgtgacctgtgtgatgctcttcacgggtgtcccgatggcgccaccattagcaccgcgacgatttatcccctccttaaacgcacccagtcgagtattattctgggattacattacggcctgcgcatcctccaccccaaagacgaacttctgcaggagatcatcggtactcaggcccaagtgacccatctggctgctaatcccggcctaccagatctcattccaaccttacgtcaactccctggatttctttccccctggaagcgtgcagccgatgagctgttcgcaacccaatcaaacctctacatgcgtctctttcatcgaggaagggattcagacagctggaacgccacaaagcaagcccttgcaacggccgagaggtacacggctgtaccagatctcgaccttgccttcactctggctacatctatccaaggtgggatggagacatctccccgtcaaatgctatggctgttcattgcgatgctgcaccgaccctccgttctctctcgggcacatgccgtgcttgacgcagtggtgggacgaagtcgagcgccgcgattctccgaccgaccgaagctggtatatatcgatgctattgctcatgagctgttccgctggcggcccatctcgcccggctccatcccgcgacgggccgacctggacgatgagtttcagggggtgaagatcagccaaggtgccaccatcatggccaatgcatgggccgttggccgagatgcacacatttttaattccgccctgggcgatctccacgacttcgtgcctgacaggtggctgctgcaacgtaacccccacaacgcagtagctcagctacggtcggatctcccgctgcccgtgtttgggcagggtcgacgcatctgccagggcaagagaattgctacggatggggcctttctgcaggtagccaatttgttgtgggcatttgatatcatgccggcggaagaggaagaaatggacccatgggctatgactgttgtggggttcatgacaatgcccaaggagctgaagatgcggctgaagcctcgaggtgactgggtgatggagaatatcaaacgggaacccaagatcggggcggaggacctggatcaagtgatgggatctgtcaacgatgtggagaaataatcggaaataatattgcgtttgatgtggagaggtaccctcgattatgggaccgatgggcatcggttaagggatgctctaacgtcacggcctgaaatcacggtctaacaacataatagatgagtgggagaaggttgtctagaggaaagtaagaataaagttgggtatgaaagtaagctcgaaactgtaactttattgttgtgcgtttcgatttaaggatgccgcagccccatcgccgaatagaaaaagcaaagggtaacaatgaacatcaaagtatgaagtggttttgtgggagaaaagcagaaagcggagcagaaacagacgcgcaagccaggaaaacaagcgcaaaatcacggataaccccaataatcagcgagacagaaaagacacataacatgattgtttgtatgatggacaagtgaggaatcataatactttattgtctccaatcattggcaagcgattgccgaccgcagcctgatcctccgcatttccgaccggtccagcgactggagagagcagcctctggttgtcggggataagaccctacacagtctcgtttcaatcaaagataaaaagacagataatgatgggtgagggagacccccatggctataacaataggaaattatacatttacggatgaagtcagtcctccgtcatcctttttcgaccgaccatcccgcccccttctctggatataagtctgatgcaaatagtactggcaccggaccttatttcacagacgatcgtgcataactacttttcatcatgtcggtgtttgcgctgcatgtcggccgcagcctggcgcaggcaatgctgaccatcatcatgacctcctatggctacgccgctactttcgtcatgtcctttaccgtttgtcggctaattctattttgcagtctcttgccattgtatctggttaaactgtcatgcaatatcagccccacggtggttcggaacttcgccagcctgttctccagtcaagggaggaaccagctcgtccaagaggcagaagagtaccggggccaatgtgagtctctggccatcgctcagtgccaggggacatatcgtttcagcgagtacaatttgtatcgcgtccgtcgtcagggaccaggatggatgcccgacattccctgggctgattgtacggaggagatggccatctgtggagccactgtccgcttcgtgcatcagaaaccaacactcgacggtcccgcaggccgcaggcgcccgatcatcttcctgcatggcaatccgagctggagctatatctgcagaaatgtatagatgtcaagtatcgacctttggatcagaatgtggctaacaccagcagatccttcctcatctggtggaccaaggtcatgaagtctatgcgctcgactggctcggacacggtcgcagtgacaaggcgacacatcctgaatcggttacctttgaactgcatattcacacgcttatgcagttgttcaaagtccacaatctccgccatgcaaccatcgtcgcgcatgactggggtgggtatgtcgttgaccctgctagtatctttggctgtctccgtccatggctcactgtctccaggtgcgtcgcgttgtgcgcaatcccgcagctgcctcaaatggcctgcactcgcctcctcctcctgaattcctttctaccgccgcgtccggacgaatggaatcttcactacggtctactctatgccatctggtttctttcaacgggcctactgggcggctatgtacccgagtcaggggtaatgcgcttcatgtccccacacttgccgcaacccgaggtcgatggatacagtgcgccgtatcaatctctcccagtagccaccaaggccagtgtcttccggtttgggcacattgtcccggtcacgccgcgctttgccttacatggcctccggcagacgcggttgtggaaattgttggaaggtctctgcggaccccgtcattttgacaaccttagtcaacaggccagactggcaaagcgcggggaggaggtccgacagagctggagagcaggcctcgagaagggtaacccagaagttgcggtggtgttcggagagcaagacccgctattgaagctgtacaaggacattctcgtcgattgcattcacccggcacatatggttgaatgggcgccacagggcatgtggctctctggaggaggccactaccccatggaagagaaagcggctgatatatccctcttggcggagaggcttgcaagctaatgatacaatatgacctagatattccacagatggtctgctctcctggcgaagggacaattcaattgcaggtgaaatatcgagttagcggacagagagactaagtgcagtttagatgatacatactctgatgggttgaaactgatatagtgttgagctttacgaatgtagtgctgtagtggattcctctctgatcggccgggtggtgaaccgagtgtgagcttgttaactagcaatttgtatcgaaatgctcctaggatttctgcttgatttaccaccattcgaaatcctgtgtcagttagccgctgataagcgacaaccaagtcactgcccactatatcctacacaaggcaggacttgatcgagtgaaagattggctaggttcgtgtagatataggatacaagccataaaaaaataagaaatcgcaagtcctacagcagataaatgaaatatttgttcaggctcggctatcattcctgactagttctcttgagtacagaggcaagctagagctcaatatgcaagaaacacctcaccatgtatgaaaagcataccagtcgtgtcggctcacacaggccaatacccttaactgcacccaaaaaaacaaaattttaatggtgcacgttactaacttcaccctcgtttcctatttcccatttctccacatgttgaatgctccgaaggaatgaatgaaagatagacacttcaaaattagggacataattcggggtgcataacagcatcctgaataccatatggcagacttagtacgagtccatggcgtcctcctcgcttcttttcagaccaccaccagccagcgaaatgatggcctcagtagggataggctcctggcggcgcccaagaccacccccgatcaatgaacccagagcgtcagtagggataggctcctggcggcgcccaagaccacctccgatcaatgatcccagagcgtcagaagggataggctcctggcggcgcccaagaccacccccgatcaatgatcccagagcgtcagaagggataggctcctgacggcgcccaagaccacctccgatcaatgatcccagagcgtcagaagggataggctcctggcggcgcccaagaccacctccgatcaatgatcccagagcgtcagaagggataggctcctgacggcgcccaagaccacctccgatcaatgatcccagagcgtcagtagggataggctcctggcggcgcccaagcagggaggccaggacttcagccgggacatcctcatcaccacgtcgcttgaggccaccgcctgccaaggaaataatggcatcagttgggatagcttcgtcgtctcgcctaccgaggccacccccgatcaaagatcccagagcagcggcaggaataggctcctgacggcgggcatactgactgtcactgacctcatagggacagatctcgttatctgtgcacacagggccgggaccagtggggatgttgacattcggattggtattaccattctccgtgggtgtgtttctcttgttatgtcatcagtaactacccagaaagtcaggcgcatatgggccttaccatggtgactggcgctgccagcgccgacgtaaagaggataactgcagtggccaaagaggtcttcatgatgaacagtttgctttcttgagtcttctgtggagtagggtttgagattatgttgtagctgtgtgatgtagaaataggatacgtagaggatttgttgcttttatataccttatgtctattgggatattccttttctgggttgacttgtgagaggcaaccgacgtcactatccagtagtatgttggaggcaactgccatctagctcatgttgatcgggtcacaacaatgtcacttgattgaacagagaatgtcctatattcagcaggcaggtcggagatccgagagctctcctcccattaactaggcaaaaggtctcacatgaggtgggagatagcccgaactccgcggcatttccaagagcagggtaaagtgccatgtccacgttcttacgtatgcgaaactgctctttgatgcgtgatgggcgaagaagacagagctgattgtactgaagcggctgtggtaacgagagagatccccgggaggggtccagcttcgaaatgtcaacggatcaagaaatgccagattcgtgccaacctcatgcatgatccaggaaacaagcaatatgaaccaagtaaatctaacatagacaattgtcgctcgccacttatcttttcaaatagtatgtccagtagtggagactaggctctgctagaccttacacccgccgaggagaactaagatgacctaaaatcttacgggtagccggtgatcctctcggccgctatcagccccagaaaaagcacggtcgtatcagaggcaaagtgtgataaactcatcgtgaactacataaatggcgcccttaatattactaatcgaaaacctgacaacccaccaatcgtacgacaaggatatactgaccagattttatgatcgatcatactactgcggcgtcatggactgaattcgggctccctatccaacaatatcttgtcgacgaccagaaaggacaacgttactctcctggaagacatgtaatcacgtgtatatcgcttatgcacctgaattttttttgttttcctccttgccctttttgtcctcatgatcctccctggataaaacgcgacgttgaacctccttggaacaagcaaataacagcctcgcaacagatctgtgggctatccctaatcataacgatcgcgcctagtatagactttgttgattgggctatctgaaaatggtatggtattcgatctatacctctacaacataatgtgttgaaacgacgttttaggtcaatactgaagtcgttgaaaacgcttgattcttcgctatctaggcgcgctcggaggagcagttgaagttacggagttcgggtcacgtgacctcgactactagtaatctactgagattacgttccaacataatgtactaacgtgtgtaatcgctaatttggaagtccacatgcccggcccactcaccatgcaggaaaccatgaaaaaggaaagatctacagggaacccaaatcccggcattttgccacacaaatagtccatttgcttaggctcaagtgaaggatagctcatgcctagtatgaattacgcatattcttgtttcatcctattaccaaaaacgaaaagccgcatgtctgcccatggattatctggctcgtgcctcgtccaacatgagactactcagaaaccggggagaccgcacctaatccgagctcacctaaatgaagatatcaaaattatattaggaggaattcccccacgtgaaccgtatggctgtgtcccgagcatttagatggttggtaaagcagaactaccaatgcagaggatcttctcaacagtatcactgccggtatctctttcactccggcggatgccggaaaatgtgacattatgtattagtatcctggcttgttctacttacctgtactagtgattggcgttctccccacctatataggactattgatgcggcatctaaacagcaaaagcaaaggcccgggctaccaacacaggcgagttccttcgcccgaatatcaccgatcagtgataatggaatgtaattagtgacttgctctcgcaagcggcggatagagctcagccccgcgatttgaaaggcggcaatcacatactaatcgagtacagacagagccaaggcacgtcatctgagctctagcttatcgcaaatttgagtcatcagttggttatagccatggggcgcctccaatagtgtacatgcatgtacgcctcgtcatgtgccctagaaaatgcgggatctacaacgtaaataggtttcaggacctatatctgctacatatactctgtttatgcagagacacgcatcggagaagtaagctggcgaaaaactcatcacacatttccttcttcaacctggctcaataccttcccattcctgcgatatcccgaataatcacacgatgtacgagcaaattgctcagcgctcaagcttcgaatcacttcctgttgtgaaggatacgcctaagcagaggttggggtatctgaaggtggaaggcatctctaccgttattctctgtcttcttgccacctttggtgtcattgatctgtgttaccaagcatacagtagcattcacactacgaaccacatccatcttcacgctactacgcagacagatcctgatatatcttgtaattgcggagagacgatcacagaggccctttcaaacaactgcaaatatgattctttagctgccgcgtggcttccgccagcttgtcggaacgacaacctcaccttggcatttgaaaaagcggggtcaaatccggatggaagctggccttactttgcagatgtgaacatgacacgaccgctgtcactgaatgaggtgtctatgcttcctgttactagggcagggggtggagatgcaaaaaacgtcttttacacgacccacaggtggcatttagtgcattgtatgtattactggaagaaaatgttcttgtcgcaagagatgggaacaacaattgaaagaagatataacaatgtggggcatattgagcactgtctgagagctgtactagaacggaaagaaggcctggaggaggttaccacgggggctggagtggcgttgcactcggattggatcaatggaaggccggatgcacaagacgatgatcatgaacacgaccacaaataatgctctgtgcgattatctttctacaaaagaacaagcctgtcaatgtttcgtttgcaatcaaatagcagtaccctgtgtttgttcgagcgtggtgtcgcttgatcactttcgattctgaatccgcaacattgtggcgtcacttctttcgaactgtgctttgggcattacagagtctggcatcttatttcctgcgatcacgccaggggcttacaaatgccatcaattagccgaccgagaccatgacttgcccacaaaggataaaacacaacattctcatgccgattgcgcatctggcatgttcatattatctaccatggagatggcattgctagctatgagttgttagagcttcttacttcactttccagattaaaattgcagacgttgttttcatcattctcaaggtttccagtcaatgactaatcttgatatgaatgccagacatctgattgttgttttctccatatgatgtaaagaggtgatgatgataatatgagatcgccgggccttcgctaaagtcatatatcccggttcccaatgtgaatttacgataggaataaggcgcaacgagaattagttcaaccatgaagctgctcagtccgggcgtcggtcctaggggatgcattctgaacatgattttctgatcaggctactatggtgtaaatcaagtagacagattgacggatccgatggggaccatatgggagagggtcgatttcatcgtcccatttctctgcagcttcaatacgttacttattgtagaatggcgggacggaggtcactacgtcagcctgaactgcacaagaacggaacatcaagcgcctgagtcgagttacatattatttatatttgtgggtttattgctcttctttccgatctacgctttctcgcatagtgcacgtgtatataggtcacaagggtctctagcattgatttcatacactcgagaaacaagtcaggtgatagcttcacccatgatttcgattgaaatgcccgtggccaatctaccccagtccctggccgagtaccctacagtaaacttagattgtagaggatcagtgttgcttcctatgtagatcgcattagatccaatagcgaccgctcatgtaagcgcctagttggagagagaagtacccggcttccgcagaggtcctatttcaggcattttgtgggacagagcatgtatacttggcgggaatctgaccaaccaatccccatttccaaattacgatggtgccgctctgaaggtgttacatgagatgatgatatggaagaaaggatatggcatcgttcgacaaggggggcattacaagcaaggtttggagatgaatatgaaaagattaggtgatagattacttaccttatatgaaatagcatgtgaagaattataatagcacaaatgatatatttgacaaaagcaacaccgacagcctataaggaatgttaacttagctctggccgaggcccctaagcagcataaaattgcatgatggagatcaccattgtgtaacattgggctaccattcaatcagcaatatatagattgggctgcaccttgtcgacgaggtattctggctccacccactaaagcaaattttcaaaggctaagtggacatgggaaatctcttatctaagtcaattatatatacagtgcatgtcaaagtcccatagacttgcgctgactagaatcagaatgtagagttgcctgaatcgttgctcatcacggcgtggacagtgaaaggactataatttagcaccttttgtattgcgcaggaaggccaatgactctgccatcactctctcccactccttggtgaaccgagacctctctcccggcgacaaatcttcccatcctgcagcaatgcgacgctcatcagtgctccatcgctctatttctgtccgtatccattctcctaacgtgctggcggtcaaatccactttctccagaggcagcgcatgaccagcaccctcaacccacaaatgtcggacgcgaccgtaccgcacacctccacttcctccaatactacccccagttctttctgccatggtagtatgaagtccggatttaaataacgggctcgatgaaccactaagaaatagcgcggaagggcgaagacgtggcagcaattttccagccacaatgggttcaggccggtatgcctgttggccaggtggcaagccggccatcacgtcaggaaagaacagcggatcatgagggggctctggaagacgctcgccattgttttcagtctgtagccccagttccttatgccggtttgggttcgcacgggcatagatcattgcctcctggaatttggttgtggtcaaagtaactggcgtctccgagtcatgcgcgccggccttgggatagagggccgtaggaagttcccgatagccccactggaaccagcgttcgaggacccgcggatccacgaccgcaaatattgccgagctttctcttctgctgcggcccgtgaaggccaaacatctcgcttgtgcttggtgaggtgaacaagaagcggagcgtctgcgtcagtgtttttctcgataatgtaaggctcgatgagcataagggattggagtatccggggatgcatcaaagaaagaaaaacgctgttggtgctcgcattagaagccatcgcaccctgggattggtgtaaaaactaacagttgtgttgcacccaaactatgcccgactcccataatgggccgggtcatcttgtgacggaaatgattcatcaggagaagtaggtcccgactatgatcgaacgccgacgctgcttcgagttagccacccaccaacgcccttgaaaatatcaggtcctctcactcacggtcattacccaaaccggcttcgttaatgataccgctgacaccttgattggtggcatcggcaatccaaatcgagccaatcttaaatccttcctttttgctcctggcataaaggtcttcccacaggggctcatagagttcctgtagacatctcagtagttattccggcatgaccagagcccggcactttaccttagcaaagccagtaccgtgcgcagcaacaattgtaaggtcaccattcttaggatcagggttgtctatgggggtatattgtttgatgcagagttttagcggagtatcttggctggctgtggctcgaggatattctctcatgaattgtgcatccataacatggtctgtgataagataaggatatgccatcttgcccgaaagattcagctaatgttcctgctgcgatgcaagcatcagattgtgaagtatgctatataactaccatctgcgcgctatctgggtggctggctgtataagacaccttgatgcgagaatagcctctaccgaaaacccaagctcggataataaatcggatagccgatcctgaaaagtctggttttcctcatttacccacttcaattcacgggcaatagatatgtggtggactcttgactgcggtgggaactttgcacccccgccagacaagatcgggtgaagatcggatccacatgggctgtgacgaacctctgggaccagtggttaccgaagatatggtccgcgcggacattcgaatcaacaaacccctccagcgttgtaagtagttttggtcccaggcattcaacacagccatggcacgacgacggtgcgaacgaatgctgggatatttccagatgctatacatccctgctaaacctctcgctctgaatctcccactgcaaaatatcctctaccgcccatttcgcccgactcttcccgttgttctttagcgcactccacacttttccacaccaaatcctcagctaaggctccacagctcagctacgaagtacagcgaagctgattgatctgttcgattgctttcccgatacggcacattagcatgatgtgatgcatccatcaatgctccaccgcgcaatcaactcctcgaactaaacgtgggcagtggatgcatattccaggcttgactgaggtagttcttgactcgtgtaaattcaaaccaccgaactactgcgattgtttacaccatgcaaaatctgcatctccgccaacggttccatagggtgtcgattgcgggttccctgagtcgcggttcatcatatgaatgacctttcacccttcgcatgatggcttacagctttcacctggctcctctcatgagcgcgtccttcttttgcggtgtcaaataccttgtgcctaagggaatcgggtattccataaaggaatcatggcgctttatcttatatcactgggcgtgatagcactcttctgctacgtaggtcataacgacctgcctatcccaatatcttctgactaagcaggtgttctcacttgtcacatatcgactctacttccatccgctggctaggtttcccgggccttggctgggggctttcaccgattggtacgcagcattctatgcatggcgaggtgacctacacacaaaggactatgaatggcatgagaaatatggtaagtgatgtgagtctttgcattgtggaacccagagtaacctggtcgcactttgaattaggcgagatcgtacgcttcgggcccaattccctatccttcaatacctcaaaggctgtgagcgatatctacgcagtcagagccaatgttcagaagtcggatggttacgcatcaatgagcccgagtcgatataccccaaataccctcactgcgattcctaagaacatccacacctttaggcgtcgcatattgacgcaagcattttcggaccagaatattaaggagatggaggatcgtatccaaggaaatatttccagctttctcgacatccttactacagatagcgaacctgaatcagggtggagttctcccaagaatatgtcgcagatgtgcgactggctagccttcgacgtaatcactgatttaagttacggcaacgatcttgacatgttgaattcacctcaaatgcgttggttcccatctgtagttcggaaaatatcccagcgaagtctaatagtatgttcctttagtgcttcctttttcaaagacataatatctctaacagatgctttagggccttttccaaccttgttttataaaattgaggcttgacttagttctactaacccaaaagtacagagaaatactagctgcggcaaggtggacccgctctcaggcggctgcacgaatgcagattggaaactatgatgagcagaaagacatctttaatgcaatgatgaatgcaagagataaaaagactggattacagttcactcgaaaagatctaggccttgagtcaatgctcttgctcgttgcaggtatgtagaaccatcttctgcagagaagctacgcggcctagaaacctccagttttcgccgtccacttatttcattatgctgaggtgtcctaggttctgatacaacagctactgctatttctgccaccttgaactacatccttcatgatgcgaatatcctggcgcacttgatacgtgtcatccgaatggcgttcccgacagaatcatcaataacaacatcttctgtgctttcgtctccggattgctctgtcctccacgcctgtatcaatgaagcgatgcggcttactccccctgcacctaatcttctaccccgaactgttctctccggtggcatggaagtcgatggcatatatgtaccggcagggacaaccgtcggtgtatctgcctataccatacatcgcaacaaaacatatttctacaatcccgatagatttgagccagcaaggtggcttgatggtaatgcagccggccagcagaagatgcaaatggcatttgttccattcagtgttgggccgagaaagtgtgtggcatggagacttgcctgggcagaactgaatttaacaatagcaagggtgttatggaggtatgacctgcgcctttcaaagaacgcatgtggttgtaattcaggtaccaggtgtgagtacaacttcaaggctggggtaaccacggctgttaatgggccggtgattgagttcagacctaggatagcatgagtatcatctgtctatttacccgaatgaatgttacctactatgaattacaatcctatagagataaaacgatgatgtcatgtgtaagtttacagatgtgataaagttacccagtctacggtggttaggatcgctactgcagcacagtggaaggcagccatggcataatttgcatgcaaaatcattgcttgtcaggaatgaagctggtgaagtacgttatttatattgcgcaaagttgtatctcccacatagccgccctcaaaatcccaacattgcgttcatgtcctgtcccagcttcttggaattttcatccttaccatcgagcttgatggcactaaggcccattgccactttaccggcttcggattgaatatcagcaattgttgctctatccgagaactgggactctcccaatccacccgggaagtccggtggagggacccccttcaagaaagcctcgcgttgttgcttgacgtattgctatgtgaggttagtgtcaatgtcaacagcacatacgttattatgtggacaatcatcctaccatgttgttgggggttaatggaaccgaaggaatgtagaaaacacaagcatcaatgtcccctgtgttttccatttccgtgccgtggatggtatcagcactccagaacactgttttcacatccgggttagcttcgtccagttcattggctcgttgtcagtcttaccagtatcacccggctcaaccgtgggataggggatcatagtttcgccgagtctcaggtgggggtggagggtaggggtgtgttcttgagcagttccaggattggccccatgcaggaaaacatccccctcatcatcgtcaagagaaaacttccatccatccagggagtcctttcgagtaggcttgaagaagggtcgaagcatccagtaagcagtagtaggttgcagaattgggtgaacgaccaaagtgcctagtaaaacgacgcattagtacggagcgagtaatcggaccaggattggctaaccttgctggggtccatggcgagacagcccgagccagctttggaaggtacggaagactgaacaaccgcctggcgcatcatacatgttcatgttggcatcaagacggccagtcagatcccacgggtcgtactcctgccactgcggtggtgttagttgtgagcgctgctagagcaacaaagctggtcctctcctaccttgccttggaaaactttgcggtaggtatgattataagcgcggtcctcccacctctccacacctccaccgtcaacgtgaggtggaagtccaaagagcttgtcgccaggggggcgaatttggactcggtcacagtaactgagtggaactgataagtcaactagattagattagctaagttcggtattatttccaattagttgcagtgttggattactcttttgtttggcatctgcagtatataactgattcatccacgattgtgttgcaagcatattaggatgtgaccttgctttcacttgggagggactccaatatgattcatagatcaccttgttcaaagtcagctttggattaatcggcattgataagtaacagtcaccttcttgtctgaagtagatgggaatcctttgaaaggtcgggaagttagatactggcgaacatccgaaagaagcttttcagtgacatctttgtccacaacgccacgaacaacagcaacaccagttcgtcgaatggcagcaatgtccgccggagatacattgccagctcgaatgtcggaaaagttcagttgaggaataatctactcctgtcagtatgtaactaacgacaaacatggaacctggagtgaacgcacattctcgcgcttagtggcgacttcttcagtccgtactttgaggacctcgacaagctcatcccatgacttctgaatttggtcctcaaaccccgtagtcaagttacgctttagatcccgaaattgttcgggcagaggcgcactttttctgccagagaaagatgtgaacacggaagagatatcaccctcttttttatctttacgagtaattggcgatgtgtcagttgccacgagacgcttggctgttcctgcacatttccctgcgcggaatgtagggcaattcagacatttcggagacaccgttttgatcatggtgggatacggggtctgcggtgttatgtggagagtgtggacagcaaatcgaaagattgtacttggaggataaatagacatgatagtctctgccttgcagatttatacttgtatccatgcttggcagctctttccctggccccagtcaaggccaatgcgcgtttcccaatttggcaagtttccgacagtggggaaaggcggttctccctaatacgtcttgccgccgcccttttagtaatagcgtccgacggccccaggaattattattgcggagatgcgaatgcggagatgcggaggaaagacggttcagtaactctagaatggtcctcactcgcaaggcttggttggcgacggaggtgaaattgttagtagggctcgcctgagttgccttcatcttgtttccttgtttccagcaactccccaatcaaacaaagtcgtcttcggtcactcgatcttgggtgcaatttatcttcttattaaaaccagactcaattttacctggccgtgtattccagagtatagcttttggtagatgcatcatattgaatcgaatgcaatatgtaaagaaggatttggctagctgtactcggccatcgtaaatggtgttatggggcccaaaatcaattgcccatttccaaatcatctcgcccaaccttgggctggtggaccaatcttacttcttgggactagaagccatgttccgcatgagttgacgactccgagcaaaagcaagacttgtcctgttgtgttgacccacccgctcgtacacggactccgggacaaagggttggtggcgaactgatgcaaagagggttccggccggtctcactgctccagccgtcgaatacgagacattcaaccactatattccagacggtgattgtaggatactggctcacgaacagttcattgccgctggcaaactctggttacgtgaaaactgtctacggtccactattctgaggggccagaggggagaccgggggtttgaatgtaaacttggggcggattcgagattattggtcttcaaagggcaaatctaagcataacctgcaaggcattgctgtagagaaatcgaggttgctcccgccgataactgtattattccatactgccctcgtatgatagtcgtagttgtgaagggtgtgaagttctcctcgattcggaaattagtccacttgtctggacctctaatgaacatttcgctagttagttggtgcatatattcattccccacgcaccagatctgctccatttaacgacgtaaacaggcggtctttcgcaccctttccattcgaaatcaaatccctcatactgactgcttatgctgaatctcattcgtccggaatgcttatcagctcatgatctgccacctcgctctaatacaacgagtgataattgcaggggaaatcagacgagctggagcttaagctatacgtgaagaagaaatgcggtatttttgtccgaatttttgagtttaatgccttagttggtggctcggtgagcgcttaggcaacagattatcagaatcctgctgtcgggtagatgtttttggtcagccggtgaactgaaggcatgctagttcatccaatctctgcgaatcagcgaaccagatatgagcattgactaatgtctagcagtgacacttggtaaactatctttaagtataaaaggatgtactttacccaagaacagtcttgcctaatctatctgcttctagtatgcttatcactaaattacgaaagattttactgcgccccgcctcactgaaggctgcctctgtaacctgcgttccatattatgcctggcatttgcctcatctgatcctcatgccatttccaaaaagctccgattagaaattgaggagcatgtaacacattgaacgcttttgaaaacatacgagtgagaaaatccattgagaaagaatatcttaattaaatgctgacactgaagtatgtatacgacaaatcgttgaaagcctccatgaagaaagctcagaacccaaggacttggttggctcgctccagaaccaacttttgaccaagcttgatgccaatctcctgtgtatcaaatgcagctagcccaagggaacgcaacgcattcacagtctgagagtggcgaaggctgtcctcggtcgtgcgcccaacaaagttgctttcgccctcaccgccagggaaatcaggaggaggggtaccggcgatgaactccttgcgttggcgctgaacgtaggctgcattttcctccgttacaggacaagccggaatatacatgacgctagagtcgccttgtccctgatgcactttgtcgacggcatgaataccatcactgtgccaggcaacatagtcacccggggcaatttgggggatgtggaccatggtttgatcgagtcgcaagtgtgggtgcaaaacatcggtcagttcctgggaataacctggggtagcgccctccagcttgcttgatgtctctgtctcgagtcgccagttggtgggatctagataggtgtctagagcaaggcgcgaggtgccagcaggaggcgaatatatgggctcaaagaacggccgcagaaggaagtaagaggtggccatagaaagtagggggttcaccaacagggtcccctctttggggccagtgtgcgacatgctcagccagccctgaaacatgcggaacatggaacacgctccagcaccgttgtaaaggtcagagacagctggaatacggcaacttgcctcccaagggtcataatcttcccatctaccctcccagatcgccttataaacgtttcccaaatcatagccattatcttcccaacgctcaacactaccaccatccacatgaggacccaatgcaaatccagcatcgccaggctggcgaatacgcaggcgatcggcgtatgtaagaggatgtgatggagacaccagagcgtcagagttcttcgaatgccagaaactcatgaggaaccgctgggtttcgagcatgttggggtgcatgcgagccttcatctgggactgtgaccagtaaagctcaaacacctgcggatcggtgggtgggaaagctgcacggcattagcaaagagtgtccgtgagcacgatggcattgattgactcgcctctagtctgcgggttcgcgcgcacatattcctcaatttcctccttatagcgtctagcttcagcttcgggaattactcctcgaacaacggcaacaccacgtttcctaagttctcttcgaaagtccttggaagctgttttgatgtccttgaaatcgatggtaggaacaacgtccgatcccattcgttcgatagtccgtacctcctcgcggagcctgtgcagcaggcgatcccagctcttcttgacagcttcttcacggcctgcaataaggcgtttcttttggtcggcaaaccttgggggcaatgccttctccttcgcgccggagagagacacaaagacagaggagatgtcgccctctttacgaggtgcttgggacgttgttgctagacctctaccggagaatgagaccggggctttcagggaacaccgcagaccatgcggactttgccatgtgactttgaccatggtgttatgcttggatcggacaagaatttaaaagattgttcaactcaaagcgataaattgatgagtgacgcagcctgcataggaagaattgaattgaattgagtgggaggtgactatttatatgatgcattttattccagtcttctgaattttccattatttctacggcttctccaagtctagaaacaatgcgaaaccttcaacgtcacgacggacctgccgggagcggtactatttcccttttgggagaaatcccgcccgccatccacagcgccggaaaagtcgaatagccgcagttgtgtgccgtgacgatgcatgtgtggggatacctgatgcctggttggattcctggccctggcacgcctcttctttcctaatgctgaaattgcctcgtcgaatgccactatattagttgaccatctgtctctccgaattaggtataacatgtgctatggcgagacccaataacgtatacagtacatgtcgatgcgctaaccactagaccaaaaaggatatgtcgcgtctacatgattagcagacggagatgtatgtacgaacaatgcatagaacgtgggtcaacataacccttcatgctaggctatgatacagcgacgttgaaaccaatcaattactaagacgcagtaaatgaggattataccttctcaattctacagccatattgttgcgagagaaattgacaatttggaatactaccagtgtattcaacaaaggtgtcaagactggaaattgaaaagaggagaaaaccgtttggtaggcgatgttgggttgccttctgtcatcatccttacccggctctgtttgttcaaatcatcaaattagtcttcccggatacgttccaatcgtcacactctattgggctctgataaaaagcctttcttttggccctaactgggaagttacataaacgtaaaaatattcaagagaagcggtggcggaagcgctgaaggtcggctgaagggcacgatagcgttatataggtactactaggtacagtggacagaaacgatctgctagccaggaagggtaccaagatctactttactggcttatgtgagttttgtgtcgttctttcctcagatttcatgattgcataaaccaggggtcttatcttgtcagggattagctaacagggaagcttgccattcaaaagaacagtctggtagtgttttggttggcgtaatccactgggggcggggcatcacatatacaattccattatggttcccgcagtttgtatagggccgatttcttagcatagcattgatagtggccagaatgctgactactgtgaagaatccctcctctcaaggatatgagggtttggccgaattccttatatgtctgacttgcttacccaccatgacaatatcagagacttactaggtacacttcgagcatcctcactagtaaagtagcgggatcctgaatgcaaatacggtcgggacggtaaatcaaagtatgtataggtacacacagcaaaatgagaagtcgtgggacgaattatccattcctaaaagcccaggtacagaggagtaagcgataggggtaattagatacagaaagagtctaaatttcacgttcagacaaccagaaatgaagcaggctcaactacctcaccaatagccccatcgaaatacccacagaaattgaactctgccacgttcatattatgcatgtcgaatgacgaaaactccagtgcagcaggtgtattcggcatgcctgataatgtacctttcgtagagaatccaactcgatcatgactacccttctcccgatccgcaagggacaggatctccctcgcaacaatccccatctctcgataaattctctttccctgcccccaatgttcactcagcctctttaaagtacccatactgagacggattctctcacgaccaagctggaggtccggcccggcaaatacgtaccgacaggcggctaaatgggcaatggtggcgttggcaatcatgcagatgatgaatggggtatgagcgtggatattagcggggagtatcatgagccgcccgagttggtctatcgcgtgcaaacatttgagtgtgtggagctggatttgagtggtgtctgatcctggggcgtcttcagctggtaccgggggtgcgcatttgcaggtcgactcgacggaactgtacgccaaggttgataatggacgatgtatctctatagcgtatgcgtggaggatgaacttggatttgaacatgatttcatcgacggtgccgtcgctgcgtagcgggtctcgcttgcagggtggaagtagcgagtgccaggccgcgacgctgatgtcggcattctcgcaaattgtgtggaccagggcggcgtttttggaccagtcggatgctaaggctttgtctattgaacgggttaagccaatgagctctgcgtaagaggagaagctgggtcggtctgcttctgggagaaattcccggatgtcgtatacttcgagggttgtcggagggcaaattaccccagcttcatagtcttcctcttcgcatggaagatcgacactcatgtctatattgctcgtgcgaaatgggtagacatgggtgctaccagccacgtgggcatccgtgatgtatacaagccaccaggtgcgacgccagctttcttctagcatcgggtcattctggccaaaatgtgtagcataatctttcttgttcatttgtatattcaaggccatttgaatggcttctttgagtaaattaacaccccggtctatttcatcgcaccagtacactgcaatcgagtagaggatcatggcctgcacgtcgaacccggtcgcagcggcttgtttgctgcgtataggagctaatcgtgactcggagattgtcgccagtggcgacgcatcaacgtcatctgcatagtgtgccccgatatactgcatcacataaaggagcggttgtattgtctcgcgctctgtctcgaggcgctggctgaggaaccgccatggtaaaacgcatggatgcgcgggatggaaaaaagtgtagtaaaggttatacagccgatctgttcttaaggcatcattttcagccgttgcagagagtgcaggatgtgtcatcgagccacttgttgtgctcctggcctgtgcctgaactgctggcaccatgacagactccggtgacgatgacgggacccacaattgatcggcagggagacccggagtcagaagtgcagacgatgctgttgaattcccaccggatcccaatcctgatgctgactctgacggcttgcgacggcgtccgcctcgacgcgacttctcatagacgcattgcttattgtcagcgatgcagcgggcacatacgggggttctcgcgtcgcagcggaggtgttttttgcgacagggcgcacatgccaggccgacacgacgggctggtttggactggtggaatgagcccgccaggtcgagttcgagcacgttcatgttgttgtaggaagtgcatgtgtgtgtcttatgttcgaagacagtgagaatgaagacggagccaaagaggggaggaattcgattgaggagtgtcaggctgctgacgtcagcctcccaacagcatcgcgccaatcaacattcacatttaaaattatccactgactgctatggagtaactatttactgtgcgctctctttctctgctttttcaacatccagtacaaagatattatgcaccccatccctgatcacttcatcgtccactatcaacacggcgaaaaaccgcgccgtctctgacccacccccagcgttctcagaccgaacatggtgacatccgggagcctcgtaccagatatcccctgccttggaaacaatcggctcctcgcaattcatttggttgaggacggttcctgaggccaccatggccaccactgcagcgcctccgtgggtgtgtgagggtgttgcgccgttgggatccatgtcgatcactccgacgaccatggatttgccggggatgttgggcgggtggaagacattgagaactcggaagttctcacggggacgactgatcatgttagttgactctcctcttctgactttgttgcggtaggcatagtacccttcgatctgccagatgtcgccggacttgatcaatttcgcggtgggggtagacatttttgaggtatagactttgctgaaagccgtctagaataacctggatttgattcctctgaaaggtttgtaattattgatattgatccaaatgattgataaacactgaaattggtgccattatataattcccattttcgaatcatctcgtacaccaaataacatgcccccccctgttgatagcccgatagcctattcggatgttgcctgacacgatccggatctgcagggcggtatttatttggttactactccattcaaccgtctgatctggaagagtctaaaaatgtgtatattggtggttgtggcctgttcctggtatgtggtgacatcatcccaataggctatccgggactgtcccaaaagggcaatatccgaaatacccgactcacatacagcatatcaatcccgcatatatatcggcttgccttcgaaaagacctactcattgctccaatttatcagtttcacatgcattcaacttcacattcaataagtatgacgcccacaacaatgcgtcaactcctccagccttccgccgaagtcgccacaagtggactaaccctcaccacaagtccacttcccaccccagatacaacaaaaggtgaacacctcatccgcgtgcatgcttgctccccctgctccggggaattattatggcccaagaacttccctccaccgaactcccgggcactcgtcccctgcccggatatggctgggactgtcatctctgcaccactagactccccgtatcaaccgggagacgaggtctacgcccgcaccaattacgtccgtccgctaatgctcgggactacaccatagcagtgaccgatgaattggcccggaagccgaagaccttgagttgggtggaagcggccgccgtgcctgtttccgcccagacggcgtggcagattctcttcgtccatgcgggtgtcgtcccgactactacccccgatgggagtgatgtaagctttgaagctgctaaagaggcatgggcgggaaagcggatccttgtcaccgctgcatcaggcggcgtggggatctgggtcgtccagctagcgagacttctcgggattgaagtggtcggcacctgtgggagcgaagagaacgccgcgctagtcaagtccctaggcgcaagcgaggtactaaactaccggacaacggactttcgatcatggggagcggaattagacggtcgtcgcaaggtcgacatcgtggtcgattgtattggtcggcaggcgttgcaggacgcatggtggacggtgaaggaggacggcaccgtactgagcatttatgcgccgcctggaagtactcgtccgcgaggatgtcaggtcaacgcaaatgatgtgttctttatcatggcgcctagttcgcggcagttggaggcgattactcggctgattgaggatggaaaatgtcgtccgttggtggatagtgtgtggccgttggagcaattcctttcggcatttagtaggttggatgagggtcatacgaggggaaagatagtgtttgatatcaggctgaatcagtagagtttctctactgtcgttgaacatgcgcttttaaatgcgttctcttctccttatcgtttaatggcatcttctattagtgagttggtactagcgaatgcagcgcaatcactcaatgaaccagatgggacaaccatcacataaacattaccaagctagcccatttaaaacggcctagcagtttctgtgggaattctaaataccaagccatgttacgatgtcaatgcgccggcgctatgtaagttgtaagtggaacttttctatttctgatgaagagtcgagtctcagcacaagttctgagattcgatattcaaggcgtaacataaacagcgagattaagcaagagggataaaatgagagttgattgtctgtagaaattgaaaacacagccgccgacagctctgtcccgccacaccatatacggcctcgatagaaccgccagagcccggatccgatcatcacgtcacccgataaaaagcttagctttggtatcttttgactactaaggcacttatctcttaagaagatatcgtgacactggcactgccagcaccgttccatgcctccaccgccatgacctgataattgaagttgctattgccgaacccatgctgcgcccagaaattgaaatggttggcgatagtcactgttccggatgtgcgtgtactttcacgaacggagaagtactgcgtgaacgtgcttgttcctgtgatagatggcgcgttcgtccgagtgtcggtgcagacttggtaggtgcttccatcagagtacacggtaccaaggctcgtggccgagctgcaagggttgtaatcaccgtaatcctcgacgatgtagtattcggcctgaggagagttgacccagccgtagacagccaggtaggagctggagctagaagcgctgtattgggcagagtaggtaatagatctgacaaccgttagatcctagagatttagcctaaagggtacagtcacccacttagaggagccagtggtccagcccaaaccaacgacgaagtcggaactgactccatcctcccagtacatggaaaatgtcccggtactctcgtcgtaggtgaagtcaccaaggttgccgttgtagttctgcacgtagttgataccggcacttcgcgacaccagaacaggctccggagcaggggccgcgaaggccgtaagcaagagacttgcaaaagctgcagtgaccttcatgataattgaagagagctgaatgttggtgaatggatatgtgtaactagaagaaaagcctgcgctggttaatgttgctgcgagccttttctatctctatttttatattacgaaataaccatttatccctttcccctgcacaataagcggttcggttgagtccattttcccgcatgacctttgataattaaacaagctcgagcctatttccagagatagctctatagttatggtttcaggtgcagccaccaatctgggcacggcacttggctaaacaactgcacttggctaaatggactagattcggctaaatagactgcacttggataaatagacagcgattggataactggaggcgggaagtggggattcttcaccagttccccgcagaagttttactggcttgaaaaccatgtttataattatataccgcctgatctactaaatatatatagtttcttatttatataatatatatctttactaaagaattatatttcttttcttcttgtagcaagcctagggctgagttatagctgtaagaaatactgaccacgggtcgcgaagatactttggaactcagagtatactctataagggataatcatggtaatggtaactaccccaaccacgctgaatctgtataattataatatataaaataaagccagatctccagatacaaatttactttctctcaggttttatctaattttcttaattgtatataattagttaaaagtgaaataatggtaatactaactagcataaaaagactggattaaactagatctgggatataatatattggctggaaaactggaactatgcgttataagattattgatcaaaatactaaaaagaatcttcgtcgaaaatatcagcctcagctgaagtttctaggataatttaaatattcattatttatcagaatcataatctatttattaatatctataattgttagaactttggatattattatatacttttatactaatttattataccaccttttagtcccgaaatgattatagtagagactccgtatagtgattataagacacaataatactaactagctaatcaaatagttgtattaattcaataatatataaatatatttatctgctatgtcatctttcattcaaacattttccttgtctctggattcaagataatttattaaatactgtaattataatataaaatctttctcttctctatttcttctgctcttactaattaataaagcttttaaagattcttaaaatcatatatattaatcttaatattatatattagattgaatatatataattatttaaattaatcaaatatcttctgtttctgcatatcatctttctctgtataccggtggcttttgtactagtttaaatactgcaaatggttacattaagattaagaaattatagtatctttaaatagaatagaaatgaaattctttaattaaagtatctttaaatatataaatatttatagcaagagagctttctgagatgataatttaattattaacttttatatcaatagaataaagtagattattatttatcttgtcttttactactactgtacagactctgtcctataatcagtcttgtgtatatgtagattgtgtttatattattatattcatgacgtgtccattttccgtattttaaatatagccccttccctactttggaacattcgagcagcctgatcgacgagccgagtccatttttatagagcttcttgttatcttttgactaacaatatacctggaatgtctttttatcccagattggtaatgatagagtggatctagactgtcttggctggatcttgagactgtagtgatgtggcctcagcagcttagatgagtgtgctgtagacagctaggcaaggagaaaatggtgcaggttaggttttaatcagtgatttatctctagaagctggttccagtcctcttttgaacttgtattctgtgtatcccacttaaggccagtatcatttcttttatctttaccaaacagctgatccacttgacaggacttcaagagctaaggttttaaaaaagtgactgggagttcaaggccttctgggatcttatatatacccatgataaaagacattgctcatatacttaaattattgattcctcgctacagagctgaattcatatttgaggactggttgtatagctaataagtcttgatttaactaccagggcttaaacagatacatacagccttctgacaggaattttctaacgaatacctcctttctccgcgaggaggacggtcttattttgctaattatatctagcttctatcctccgttctctaaacggtaggaccagtgatgtaaaggagaccatcctaaagtattttcgactgctactgacggaagaatcgttgacaattctaagcttccaagtttaaacctctgagataaactgcaaatagtatgtcgtagtgtgaactgcggatataatacgtcccgtgcgggttgtgtaaagattcatgtaaattaccctcctgtgtatttttcggaaaccttggcgtttccgcaaaaacacccgtggaccctgtgagacctgcgtttgtcgcgtattccaaggttgtactagggccaatagcttgaaaaccatgcatgggtataaagaccggtcgcatccgcatatattccacgctttggtttcataggatcaacctcggaaatccagctgtgaacttgtacaacaaccttggagacgttggcaaagctatccctttctgcccaccatggccaaaacactagaagagtttgctcaattagagcctctttgggacaaagcaatccagcatccagcggaaatttcacctgatgaaaaacaccagctgatgcaatggccgcctttagaagagatgcaggccaactcagccgaatacttgggtatgtcacttgaaaacttgcttcaaaaggcagctacggaccgtcaatccctcacatacgcggaatgtcgtctgattcgcgatcatttccgcattacgccaactcttgacaagggtgatcgattcgcgtggccgcagatgcgtcctgatctttacgataagctgaaacaggcacaagaagcagctcttttaccaatagagcttcaggccgttcaagctgtgaatgaggtatttcctcagaaaatgtatgatgacttggaggcaaggcatgaaaagcgaaaaccattcccagatctgcaagactgggtgcgaaggattgtcgttcgagaagatgataagagctggggctatgtcttttaccatcagaaaggaatggccagactggatgagtttagggcgctatttgccgaggtccttgagatgtctttcggtttcaagggatatgaagagatacacgatcacaaattcgctcaatttgtcccatttgaggccgatgagagtaacatcagccatttacagcagtgagttttcctacataatattgaagacatttctaacaatcagccagagactttcgtgatcgccgcgagaggggtgacttaaagcccggtgttctcaaaaatgtgttcttcttgttgacagacgaggccctttcagcttgtggcacatatggcccagatatgtactatggatggatatgggcaattgatccggactggcctctgtcgcggccagatgaggatggctatgatggccgcctcaaaatcagcatcacccagatcttttaccgtttctacgaattcatgtctgatggtctctcgctcaaagaaatttggcaggatttccattacgtcaatgctaacaagttgtacccaagctattggcgggagccaatttcctgggccattacccgacttgagaaatccaaatggccatacaattgatttgatgcatgtgtgtccttgatgatttttatgtacatagtactagatagtgagcatcacataaacattgaaaatgtgtgatcatccgtagaaaatgtattcttccttccgcccatcttttctagtcatatcattggaaaatactccacttccgtcctttttgtcagctaaaaaccaacttgaagcaactagctacctgatgtctgcatataaacgaagattgattcgtcaaaaattactcttagtcgaaccaactctctgaactccatgagatcagccatgtagattgttgcgacctgatatgcgtgcaatcccggggtagctgcattttgcaccgcttgccatgtgacatatagctcatcaatacgcgaattaagccaattggaggcccactgagccattcgtcgcatgaaatttatcatgaaagttctgaacagattaggcgcactgaagtctctttggccgaacacactgttgactgctttctggaacacacccaattcgtaaatagccccgccatatgtgtcaacaaggtgacggttaacaagctgctggttcaagtactcaaacacagatataacctgaattaaacgaatgaagttagcacataaataaatgattgaaggagacttcgcgtaccattcgtatttcattcatcgcagcccgtccagctctctcatctgccacgtttagatccctccaagtatcatcaccaagcggctgcttccctgcgaacagctatatgcagtcatttagcaattttctctttactgcatcaaaattgcaaagagaaggcttatcatagtaacatacccttcctttcatcgagttcaagtgagtttcagtattaactaatcgagcggagttaatctttgagccgagactgttgaatatccgaataattggagttccagttgctgtggtgtgaccgctggcccatgtcgaataatcctgattcagtagttgtgcaatgtcccaggacatacgtttgctcccagtgctgaagtctggcaagccctgcacagcaggtaaagttccagtaaccataactttaattgagcgaggaatcaattgaagctcgaaaatatgctcagctatgaagaagtagaatggttaatacatgtaccataacgcccgatggaaataattcgatgcaccatgatttgggagcacttactaacccacatccaaagattattgggcgcgttaggatcaatagaggtatcagtgcatacacattgatttgcgaccgcaaatcgcactgttagttcattggcatttgcaaggttgacaccattgccaccatttggataggccactgatgtaataatcatgattcgctgctggcaagtaattggatcagtaccgcaatcaacggtgaaatcccggggagctccatcacgtttgtccagactgtgaagagctcgtttggttgatgcactattcgttccgtaggtatcagggtcaatcgagtattcatcatcaaaaccgtcaagatcgctgatagcgcagacttcatctaaagtactgggagatgtacaatccttgattatctggttccagtactctaggttgcaaataatgcgacctgcaagatcctctgcgttcacagaaaacaattcacctgtaacatctctcaagaatgatataagagtggaagtcgctagataagtgaaccgagcggcaattacatcgttccacaccttgatttctttgacggctttgtttgtcctgctcgtcatgcaataggtgtagatgatatcaatcacaacaattagaatggaattacttgtgaacaatgattgtggatcttgacatttctccaaagatgttcccgaggagccggcataccgagatgcatattccatagacaacatgtctgtgaagcctcttttgccgtagcccacactaaaggtatcatcgtagccgtacccatagccggtagagcatgtaggagtttccagccaatctttaagatcagccgtccaaagctctaccatagggtctacctttttttgggtcgtggtgtagttgggagaacagcactttgcacgggagccagtctttttgttacaagtattgtagtgcttgatagctactcgtactttgtccttggggcagcttgggaagcagtagccactcccaccgcttccactaccaccatcagcaggaatggcttggtatcctgtttcgctatagtcgtcaagccactcgcagtcgtcgaaagtcatgttttcatcagagccgttacagcaatatttgcgctcctcattcaggttggttctccagtcgccaccgcaagccgatcctccattgccattgcatgacttaagaagaacatcagtcttttctgctgggcatttccatgaatcgcattcgaatgaagcaccccattcgcatttattatagagcgcagtacacttttgaccactcgtacagcaggcagcttggtaattaccaaatgcagttgaacatccacggttggttccgccaagttcaaaactaccgtctggacacttgccttcacagtcaccgttgttgaatgtataccagccgcaagtcagagcatcttgatcaggaggacagcacagacgatggtcctgatttttgaagatacagcctccattatcaagcatccactcaccatcatgatgtctatcatcgtcatgacggcggagcagaacccatccatctgggcagaggtctccacagtttgtccatttgcactgatcatgtttgattttgattgtgttgtctgttttgattatgtcgggcagagctttaaacttgtgttgggctgcttctcccaggacaagaaagtaagtcccattggtatggtcatggcttactgcccataccataaggcctcctaagcatttccctctggcaaagtcagctttgagcttgaaggtgtcgatatcatcataggatacccattgattattatcccatataatcatcttcactgcagcatctttatcatatatgattttggggtgttttcccgcgataacctcgtcaatctcggagttcatcaaaattccaacctcatgactgcagtctccagcctccgccccggacgcaaaaaggcacccagggcttagtacatgatgggtcggcaatcgtatatgctctgccgtaaaatgctattccaagaactacctgatccggtggaatattgtttcgccatagtagatccagagaagttttaatctcaatgagattggtatgcgcgtcgaggaattcaccagttcatttgtttcctttgtcccaagttccataaagatcataggtcatgatattaaagaagtccacacttttcttcatagtcccaatgtcaaagtgttgcaagtaccagaaagaggcaggcagagttatactaagaccatctcgactaccagttcttttgagtgccactttgatattctttaagaacttagggaagttgtcaaagtcttctggatgaccacttcgatcgtccgctgctggatattctcagtcgatgtctacgccatccaagtcatatgtggacatgaactttgtgagagaatcgaagaacttgttttgattggatgtcgatgcggctaggtcggaaaatgtcattgcagttgggccaggtcattatagctccaacctccaatagcgatatacactttgagatcaggatcttcttgcttgaggcgggcgactcgcttgaaaagctcaatatctgcagtcaaagaagtcgaacctcgaacgtatcgggtcaatgactgcaagggccacattgatatgggtgtaactcccaaaggaatttgctcagaactgtttgcatcgacgccgagtgctccaagtctcatagtatccaacaacacgctctaatgtgtgcgttgaattattgcaagagggctgtttcactgttttcttcccacagaattctgacattgttccacagaagccaaactttgagcagcatatgttcagaggacaagacgattttcagaccaatttaacccaaagcccgggtcacattctgcttttctttcacagctagcaacacagtcatctccgcagactaagaaagggttattgttagatattgaaaaccaaaaatatagcgatcgatcttggaattaacaacctcaaagatacgtttttcagctgctttcttattgctcctaaatttctcggtagcgttcaaggtgaccacatcaccagagacattctgtgatcgagcagcagcgagtaatagctcgagttcgcgacacgcgagctcaaaatgctccaggtttattaaaatctgcacgatctgccccagatattgtgaggaaagccgttcgacaagggtgtcgcaaactttgtctgataggagttcatccaatgcctaagatggtaagcaatgtgaagatatatatgatatagtatacttacatctctcagggtctcgtcaatgagactaggatgagagaaatcgtcattggcaaaaaaatagaactggttcaaaaagttgcggatgtcgatgcagcacaaaggatacatttgggaaaagggtaagacacacggaaacctgtactatcgttagttgactgagatgagtgtcttaatttgacagtagaaacgtacacttgctcctcccttgacttgtcaggactgtaccaactgacattcaatactttatcaaattcctcgattgtctgtataggcataggcatataatcatcggtcgatactatcttcacaggtctcaatatagagaaatggaatcagtttgtgaggggacatacctctcggaaatcgtcactaaatcttttcttgagcagatcggcatatttcctgaataaaatcagaaggaagtcatcaaaaaccccgacgtgaaagtcccaggtctatttgtcatattagttaagatatctcgccaacagtcaggctcggaggttgacagacattcattgtttgcatgaacaatgcgatgagattttttattttcagtaggctctcagcattgtcaacctcatggagagcctccgatatcaggatcacagctgtttggcacatggaatcccataattcatcgacctgtttcaactatttcagcctaacagatctacccgttcattcagagagcaaactcacatcaaccgaagacctcaggtccgggaccctcttcattgtggaacgctcaacaatggcaaagcctgccatttcttcgagaagattgtgcagactagcgccatcttcatcaataagagttatggaggctggtaacaaaagttccttctgccgacgtcgagtattagcgtactcaactcgaaatctatccatatgccctaatgatcggtgaatgtggagacattcaaataatggtgtaaaatcaacctgaagttcctcattttgcaaaagatcgtactcttcgctctcgtcggataccagctcgatcgccgaatttagcttgaactggccaagatagggtgatatttctgtccgctccttatgcctggtctttcgcaagtcagtatgatacaaagcgatctccccaaggtactgcgacatctctcggattctgtatagccaagtgttaaggtcagacatgacagcttccgctattgctttttgcgttgttgggactgagcgctggatcatgtccgcaattttatattgcgttacccctttaagatggacattttgcaattcttctagagcgcgtagtgcggcatagtgattcttcttggcgagcaaatcgtggacttgattcgcgagacgcaacacctccagacagtcctgtatagctctgtatgtctcatcgatgttctgccggtgactccgtgactctaccaaagctctcttctgttcagcgagcttttccgtgcttgcttgtatcgactggttgaggtccaatatttcagcagtcaggctgactgtaccttccctaatgcgcaaaagctgattcactgatgttacgaactcctggtgattggtattgcagatggtctctatctcagtctccttgtcactagcaaatctagacaaagtctgtgatagttgtgatgttcggttgccaacgctgtactctttgatggaaggaatcaattggtcaagatagtccgcgtctgagggagatatgatgagctatggagacccaaaatattgattagtagctcgtcgcagaatccctttgcctttgcgtacctgattcaggaggtatgacggctcattgcgagaaggtgccattgatggcattgcgacgagtttgtatgcgggatgtgtgctgctggaatcttttttgttcacgctctcggacgcggcagctaacagaaaatgatccactggtgtgacaacttgctcacagtcggagacaaaacgcgcgttggatcctcacagagtgagaaacgcgtcaaaggaaccgacaaaagcaagccaattgttcgtggaaacagaaaagtcattcagtttgcgcaggtaaagttatacagcatactgagattctgataactaggagggggatgaactccgtagttgtacttgattacgttttcactgccaggtttctaattcctcggccgttgcggggattccacgagatggggcatgcattcctctagcccgctttggaaacagccaaacttagttatgttcaatatccaatgaaagggtgaagctcgccgccccagactccttctactccattgagtgaactatgatctataaacaataacgaacttaggtatttgggttgtcaaaagaccaaagttctgcctactaaggagagtcagtgtttcacaatcatcatccaaatttaaatcctccaaggatcacattgttcgccttttcatacacctggtttgcttggtcccctaatatgccccaccgagtaaaagtcacctttctcgagattattattgtatattatctcgtaaaggctccgaagtggtctgcatattcaggtgccatagacttgaaggcgactatcattgcttcctttgtcctcacttacccttttctttgaaagagaagtaccactgatactagcatcatcatcttgagctgagctgaatatttcgacgggcaaacctcgcttggaataaactaccaaaagatggacgaaacgggggccggggctgtgggagagcgataccgatatgttcggatttctcctgagcatcaacatcaagtagtaatctgatatcagggttctcgattggcccttattggaatcttgtgatgaaccacttgcacaactgaaaggattacgtgagggacttctcccatgttgttttattgaacatcagtatcgggacggtttagttgagtctgggagtcacctcttactgtaaaatgtgcttcaacaacccttttactcgaacgacatattccccacggtatcttgattatctcctagtatgtaccagggttcttgtgcttcgtaatctttacaacttatgagatatacgagggcaatatttttgtgttattaggtcagtgcaaattgattgaattggtcattctccacccttggcgcctagattagggatggcggtcgtggttccagttctgttgctgtatgtgtaataactggctctagaagcggcatgctatttgggttttttttctttctgtgggacgtgccatttcaaatatttcccttgagatgtgttttgttggtctattcccacttttcttgtgcttccgatattcgacgtgattgagggattatcttttgatcgattgtttctcgggtatacttctagacggccaaggcctccacttcaacaacacggtttcctggaattgctccgctgtaaggtatttcttatcctcatctgactgtgtgagtccgggctcggtctccaagacagaccacattcgataaaacagagagattctagatttgactggatttcatcaacaacctcacagaatgaggccaaacgacacgtcccacggcttgagcagtcctatttctacaaatgacataggttctgccaatgggtcccctgacaccaagcttacagcatattccccagaggatatgcgatctatatgccttcgctctgacaccagtgttggtgatacactgggcgacattggggcacggaagttatacctggcgtaagtgtacaaaatgactatcttaatttcagatctgtcagtgacaagatcaggtcatcctctgaccccttcctggcgtcgactaacacctctacccgtgttcaactctcaccaacagcggcaagcttcacgccaattggcacggcggacaatgcgtcaattagaagtaaagcaccttcactgtctcgaggcttttctggcgctggctatctaacagcaagctcggatattgatccatgcgaagctagaaatggccctctccaggcctcggacagattttcactgaaatatggagttataggcaacagtcaggctgatacgagggaccatccggttatcagggactacgagacatttggcagtgaaagccatagccgagccctggttattgaaaatgtgccgaaaaatctcacctatatgtccttggctggatttttcaatgtaagtggctgagttcaagaggaagagtggatacatttactgccctggtcaggggtggcgagtaaggagtattgatactgattgtatgctggacagcgtcgtgaattcagctccctcagaggccccgtgctctcggaactcagttccatgggaaaggtctatgtcgcattcacggacagtcgggaagcggccaaggcaatagaaaaggtcaaggttctcaggcccgagtggcacgtttctacgattgcccctaaagaatatgtcaagcatgttgagccctcccttttgccacaaacttctaactacgagggtcaactgcttgtgaccgtctactatgacgggagaaaccccaacctcaatcagcacactattgctcgctcacttgagaccctctctatgacattcggcgacataaagacttttgcatccctaccaattgagcaagagaatattggcgaatttcacattgagtacttcaacacgcgtgatgctgataatgttttgaccacccttaatgggacatcggttgatgtacgcagacaaatcctttttctgctcctctaagtggctaataaaagttgttgaaggattgcatcctagatatctctctgttcaggccagatatggaagagagaaagtgcgagctgccatttatgactacaacgtcttcaagagaggagttcccatcagccgaggagacttctttcacaaaggccacttcgtggacctcagttcgaccaagtcgtgcttctttcatggagctaagccctactggtcgctccacagtccccccaggtgaacatgctagtctcatagactggatgtctaaggctggtgaaagaatcttcccctcccctcgccgcgaacttagtcgctatcctgatttacgcatgggcagccaaaatgcagtcgatatagagagaatacgtctcggcttggatgtcagaacgacggtataataaccggcccatgctctctaatatgctaactgacgtgcaccttcacttgcagattatgctgcgcaacatccctaataaaatcgatcaagtaagcaacactccaagggaaagatgctattgtcagcatggagactcggaaatcctaatattaaaaggctatgctcaaagctattgtggatgagacaagccatggaaagtatgattttatgtacttacggataggtaagttgacattccccggtcaaacttgtcgatatgaaacgactaatctccatgccatgcctacagatttcgcaaataattgcaagtatggctgccaacctatgaatcgccgccaatgtcagtatctgataatgtctctgccagcgtcgggtatgcctttataaatttcgaagatgtaagtttattcagcgacttctccagccgctactgacacatacttagccaatcgatatcattgatgtcagtatcgtctcaactctcttcgtcgtaaccactgaatttcatgtagtttgtcaacgcaagagcgggacgaacctggtatgctgagactgaaggtattaacagatttccattgtgttaacgcatgtacaggaattgtttcaacagtgacaaggtggctgaagtgtcttatgcaagttcgtgctcgcttatcccaagcaggctatggattatctaaaactccaggtcagctatacaaggaaaagattgtttggtgcaaaagttccgtaacagctccgtcatgctggaacatccgtcctttcgaccaaaggtccataccatccctgctattcagtcgacgcaactttagataacaggcttattctcgcagatttttcagaccggcacaggtcctctcgctggcaccgaggatcgctttcctggaccagacaacccttcgaaaatgcgccgcagcattgaaaatgcggaacatgttggtaagagcacatatctgcgtgccatggaagaattgcactcatcagcatctcttaggactctttgctccgcgcgtgggtcagcagtaccgtgacgagcagcgccgtcgccgttctcaatttgatcgtggaaccactgcagcagagcgcgaaatagtatatgtccgaacattcgcaccaagacgtccctatggtgtcggtaatggtctaagaagtacctcctgtacttatcctgggatgaagatgtggcacgattcagtgcacgaaagcggaccatgagcccttcagctcactataaccctcaggggctgcttctggtcagccggatacccatctaatctaggaagataaccaaggaaaaatgcctacattgccgtgcctacgcttgcggcccgggagagcgtacaggtagaactaaacgactaccactcgctttctttacattttaaactagaacttcccttttcatgtttctgcatgttttctgctactatgtcggaacccagcgcccgattggagcgacggccagcatttgacccatgggagaaaaccttatggccctggttggcttggtacggtgtctcaagttgtgtctgaatgttggaacccatcctctgagatttcggtgctctactcctaatgttcattaatccctcggatgtccgataatctgagatttgaatacatccagaagaatcaaatcagttccgttgcatggcattctcgtctttctgatggagtggtggaagtgcgttcctaagccttacatgagaccactgcaacccaggggcgctatgggtgaagcggggataatggagtatgattgaatcctactaccgtgtatggcctaggccagatagtaatttaatggaatcgtcgacgcagtcggtctacataatattgccatcaccgtggtacttgaaaggtgtacgcctccaccattatcaacgataaggcatgcctgaccggggtaaaacagaccagtaactcctaggaaatgttgctcaattatgatagtctgcaattaattatgaattttatttacgtgacaattgggaagttgctacgtacacagtaggtcatgtattcgggtattctccccgaaggagcttaacctgtcggtgctcggcaaggttacagaggctaacgaatttaatccctagcggcggttacttagatcatctatccatcggctccaacccaaacgtcgggaagtcttaaaaactcaagtaggctccgagacaaagttcatcaacctataattcaaagcgccacacttaattgttgcgatttctctttcattgttctgcatcaaatataccgctttttgacacagcgcaggaccgctcatctcacgtccaggctaatactcggtagggtcttctcgttgttgtggcggagaatgagtaccgatgtggaaagagtttatgcggtgcattctatacttcatttgatctttcatcgaaataaaaaccaacatcgagggactaagtggtggaaatggttgtcgatattgaaacgagtcaccttgaagctcgccagatcccttgaccatcagcagtcatatggcagtgttgagtcttctgctgatcaacttagacatcacttgttgacctatgttatgccgaagtgctaccagtaagttaggagagcgaacaacaaacgaaatctcagcgacttcgcttcatccgacgccgccaagcacaattgctgatttgatatccagagcattctccgcagttgttgccgatggacagttctctactctgggaacagtcttgatagccactcttgcccgtttggcaaaagctacagagatcgataaggagttgaagttgccatcaaacacagaaaaggcttccactggccccgtctacagcaccggtgcgcaacgaagagaggacatgggagtcgtcctctgccgccctgcatgttcttcaacacccactttgccacacaggactcaagtcccgggaagctcacgtcgagctcgcgatgagagatctctaaaggccccgaaaggcaccgtaggctcgaaagagaaaagcatgcgaaagaagaagcggaaaaaggatgctatcgatgatctattcgatagccttctataggagcagaaagcgggtctcgctgacatgacttgaacgctagccactagatatacattttaaagagcataacttaaatatgcagagcattcctatctcttaggttccgctcagttttctctcgccctctgctttcacattataatcactccgctcgtgaatggttcggcagtgttgttgatatcacatgcaagacctcaccaaacaagttaacggccaaatggttgaggatagcccacgccattgcatagaggtacttgggggagaagaccgtccagataaagagatgcgacctcaagatcgtgcatgccgccatgacagacatcaacgtggctgccatgtggaaagtgagaacagccatgtgaccctctctttcatgcctagcctggtttagcctgagaacctgagcagccgatacccaccatattggccctgcccagttacttataaatgttaagatacccaccaagacgacattgtaggtgccaatgccattatatgcattggacaagtcaacggtggctatggagtttgaaccgccaaatgcgaagaaggtcatatactgcgcgatcacagatgtaatagctagctcgagggcgtgaagattcatcgtagcaagtatagtgacatgggccccgagtatcaggaatgccggaatgttcgtcgcctttgattgagttaccaaaaaaagggtgagaacgtcatggaagacggtactcgggacaactgtaacatgttagtcattgttcgggacgaaattgattcagacttgcctttcgtctcacgcagtcgcgtggtattgctggtgcacattgacagtggaacgagaaacagaatccccactacgaccagccgcgtaaagaggacggtagaccctccatcgaattccctcttccaaagaacaagcagagcttcaggaagaagttcaggggaatctgatgccacatatgacagcttcaagaaaaacgcgctcgataccactgcgacacaacatagttgccaaagctttgatagacgacggtgcgccaaaaggtgcctacaggtcatggcatatgttgatataacgagaaaccagagtatgagccggtgggaagtgaaaaatgtccgggcgatgtctggttcagtagcaaatttctgacccgtttggttccagcgcctcagaaccctatgtgatagcagcagcgccaacgcaccatacttggaatacagcaactcatataagcgatagaatcctgtactcctctcctgtgagggcacggaacaacgcggaagaatggatgatcttacatgtaggtagaatacccacgcagtaaacgtccaattccaaaattgttgctcttcctccacatagctactagcgaacatcatgccaccatagcttagaagacacagtgtaaagaatgcccccgcaggcccagacttagagagcagagtgtaagtcgtagggagaggaagcaggacaacgaaaaaagtgatggctaagcccagaaaaagatttctgagatcgtagtcactagctgcgctactaattaccttctgtgcatgcttcaagaactcaaataatgtcgactcaagctcgtcatgaaaaccatccttgtcggttccgctggagtgttgaagcaagcgatcgacccgaaaccatgcgcagagcgcccgatcgacgtcggctaaaggcccggtgtcgcaagcgatgttcatcgaattgatatcgaaactgtggctaggaaacgtctctttcatctttctcaatatctgtcgggaattcgagagcaacacttcagtcctttgcgatcctgagccggccattcataagtatgatttacaattacacggactagcaaggaagatgtatacatacttatttcccacaaatcaaggagttctgggataaagactcccagactattcaaaggtatcggtaagcctaagagtcctgccaaagtcggagttatatctgtttgctcaacggttcggtaatactggaagtcactatgcgagtctgtcggagactgtctgaggatatccaaggtctgaaacttaggagaaataaagagcaatgcgggcgatgtctcacccacggatgagccgccatgattcccggcatcgttcatcccatggtcaccacataagacaaaaagagtggactgcaaatgttgttgctgctccatgctcatatatatattagcgacaacagagtccatctcctgttgctttgttgtcatgtaagggctgtataatacttgtcagcccgcgccgaagccaaaagctgactggtttcccttacctctgagggcctgctttgtgcccaatgtgatctagtccaaggtaatgcatgatgaatgctgaccagtcgtcacgtagaagctcagtagagacgtgacgagttacgttgttgtccacttcgatgaagtcctgcgcgaaccagcttagctttcacattgggttcaccaatgtaagcccgtttgcatctactgaccgacacaaagaaacttgtggtaccatctgctctttcgaacatcccagggaatagtttgagccaagtatcatccccatacatgacaagctggcctccgtttgccttcaactgtgctaaccaggtatcttgatatgctagagtcgacgaagtatcggactctgcaatattcaaaattacgtccagaaaagatggtattgagccagtcgttattgccttgagtcgaggcattgtgacagttggcgaactagcataagcagtgaatggcagtgcagctcctgatcgaatcaggctatgggaacaaaggttagatagatagctccttgtttgagttttactcttgctgacctttgggtaaacaggaacccggacttattagagtacacgaagtcactgagtaatttcagctggaggcacgaaaagccgggagcatttcggaacagtcatacctccttaaagcgtcgacaaccatgaaaatgactttgtcaaaaacctttggggttgccatgtagttgccgccatcctcgaattttgcaagtcctggtatcaatggcttataagggaaaaatccagacgagaacactaagacagctaagggggttaatacattggcgatgattatcgcccaacttcgtggtaggatggccattgagtgtctattcccctctaagtagcttgccacaacataaaatcagacatccgaggctactacttcatatgaggtgcgaaattcgggttatgctatgaccactggtagtaactgctaggggacagtcgcatatattgatgtcgtataccgcctactgaaatgggacctgtggggttatttccgggcatctagatagtacttcatagtttgtaaatcacagaattacaggagccatgctatttatctgatattccatctactaatcctttgtagctttagcatacaagttttgtatcacgctcgtgcatgcagagggaatatagccttgaagtctcaagcatccgcttggaaatgacattgcagccatactcggccctgacaaaaccaagatccacgcccagttaaagtttctacggctgaaatacaggggatcagatgcgtgaaggcgtccacaaatgctatcgcatgactccaaagttctgcccctttcctgaaatgtcccaggaagacaaaaataactaataactaaaacagtggtagttaataggccacttctcccacagaacgccaaactccatatatgaacagaagcccgactatttcacaacgaatgaagcaaaacatgccacacgtttcaccgtctctttgagtttcctttaacctttgatgggtgaggacggaagacaatggacgaacgacttttcttatgacgtttctggattcgtccagatttcctggtgtgagcatgcccacccttagcagttccttgatcgatatccatctctgtgaaagagttaggttagcagggagggtggcataaaatggttggcaaacaatcttaataaatagaaaatctggttgcatctagcttacctccagtggaattcaatacattgccagttactttgtcgccgctgttgtctgagttgcgcataacacgtcagctgtggtccggatatatcgaggaattttcacatacctgtggttgcattatccaattccatgcttggcttttcctcgttcggccgaggctgagaagctagctcttgcagcttcgcagaaagtctttcagtccttgcatcgacagctggcccaaagactgtggctcgaagtttagctctattgcgcttggaaacactcgcccggacgctctttgccatggtgctcgtcggctaatttcgaatagcaaagaagagttatgggtaaaagtaaagtttgtagaagacagaatgtagcgatatcaatgatgacactttgtgaagatcttaatccagagatcaagtgtgtgtagtgaaaagttttctgtaggactcgccgcctgtatttgccggtttgccttttttgtttttcgttccaccacttttttttttcttgggagggaagtttgtaacacaagcgcggtggataatcttatgtcatcacatcaagaggctcttctcacctccgcaatcgccgccggcctggttgatcgtgtataggttgtcattggcatctagctcactcagggcctttcattgttagctttcgaccgacttcaaatacttgtcataccagactcgagcaatcacatctccccatctccacttgcccaagattctggagtattgagatgtctttgaacagcgttgttgagcatagcgcaattgtcttgagccatctttcttcctgagataacgcctgcatgctcatttagtcactggctagcatctttaaaccctagtcatggcctctactggtcaattttcggatacacaaagccttgttgccctagtcaagacattgaccaatgcgcaacttaaggatatactcaggaacgaaggacttgctgtctcaggagtgaaagcttcgttgcagctacggatcattgactgttcgttataccttgtttcatgttggcttctattttctaggcctagttcaagaattcatttgcgaagttgttaactcttcatgaaacgcaatagacattgagagactcaaccaaggaggccatgttgaacagtatgatgacttgagaaaatttatctatgctacggcacgtcggccaatacctatgtctccaaccacacaagcagtccccggccaacactatcaaccacataccgtcaaccaacctttgcacacgcagcatagaccatcacctttgagcataccaatgccaccacatggacaaacatctggtactcacttatattctcatctactccgaggctgcgatggtttctcactatcatacaggtcgtttaaccttcaaagacagcccattctacaccgttatagagccattgacttctgcctcggaatgcaaaggtagggcactggcagtatagtcctatttcagtgacagttcacatctaataattcatgaagttcgcgaacaaactagggacagcgtggaactcaaagttatcctcacaccaaccgtagcggctaggctacaagcggatcccaacattcgggtgatggtgtattgtgctgcagacactggtcttaatcagtataccaaatccgacatcgcatttcctcaccaagtcgaactaaaggccaacctggatgaagtgaaagccaacttgagaggcttgaaaaataagcccggtacaacaaggccagcagatgtaacgcaatatattcgcaagaaaccaggctacccgaataatattgtcttgacatacgcccttacgcaaaaggtaagtataagaccgccaatcatcactttatcagcatgatactcgctggactttgacttggtaccccattttaaggagcttgactaacagagtttagcgcttttttgttctggtcaaccttgtccagcgacatccagtcgaagagcttgttgacgaattgaaaaggaggaagacaatctcgaaggagcaggtcttacgagagagtatgcgcctggaactatgattaacggagttattgctaatgccctacagtgagaagtaaagctggcgattcagatattgtcgccacgtccagtgttatgtcgctcaagtgccctttatcgacgctccgaatagaggttccctgtcgttctgtaatctgcacacacaatcagtgttttgacgcatcttcgttcttgcaactccaagaacaagccccaacttggtcgtgtcctgtctgttctaaagcgacgagttttgaatcgttgcagattgaccagtaagacagaaacacttgactcgaatctttgtgcaggtattgacatttcaatgaataggtacgtcgatgatatacttcgttcaacttctctagatgttgaacaagttatcatagagccagatggtcgatggtctagccctactcaggaagactctgccaaagtgggcggatatactccggcgacagatgatgacgacgagttgatagaaataagggaacccggggttacgcccatcaagcgagagtccttcccaccgccatctttcttcgtacaccaaacacctactcagtcccgagaaccctcagcgacatcgtctgcagcttatttgtcgacaaacaagcgtaatgctgcccaggtgatcgaccttacgggaagtgatgaggaggatgacgctccagtcagacctgtaaaacggccagcgtttaaccagatgaaccgaccctcgtctcagcaggatttctgcaacccttacagcggtggctatgccaacggagacattcaactacccagccagcctagttctgattttcttaatcatgctggtggctatgatgcacgcagttattgaagcatacttgcaaggtgtcgggcgcattcggtttcatgggtatatccactacgcgaatttattgggagcgttggacaaagcatgatagggaaacagatttacttttaacttcaatggccaacgaagatttagatccaatattcgttccagaaaaaagacatgtttaatggtcgcataacgcgcttacggggaactctacgtagtttggggtgtcattcaaagactctgatgtaaatgctctgctgcgttggacccagaacactcgttatgccgggttattcatattcgtaaggggacatatcggttgtaagtagataggggccgctccgtcggagcttgggatatgtcggcggtcaccatgcttggctggcctactccgagccgcataatctccgcagaacgccagcgtacaagggtgatctgctattacaaattcaccgagttcactttcttcgagtaatccaggctaccctacgataataaggctcctccacaaccgtggtcactttaacaccttttacaatgtcgttggatacaccagcttcatccctcagtgcttcagatcctcacgcgcggctcctgggtgcctcttgtcttgatttcctcctgatagagctcgtccccatggcggagcgcttagcgaaagaacttgcgtcagaagagaagctaccagatgatgaagaaatccgggaaactacattctttcgcctcgaatctctaggttacagggttggacaagggttggctgaacggtacgcttgaaagtccgctattcgcctttgcgacgtcctttcggccctccaagttatgaatccatttgacaggtggatatgcataagaacaacatgatcaccgacagatcgcaggtgctattgatggaagtcccgcagctaatgcatatctgttgtcgaccggagcagattctcgcgcgatcgcccacgatttgcagataacctagacatcataaagttcctgtgcaaggacttatggacgatactctttaaaaagcaggtggataacctgaaaacgaatcaccgggtaggcagaacgaaatgcggccccaaatctctatgaagtgccctggttcgcattttgggggaagaggctaatacctgcactaccagggcgtgtatgtcttgactgataactcttttcgaccatttgcaaggatgagtacgtctgttcgaagtgaggcggtatctatggcccaagcggtgtgtttgtcccgggatacacgtatcccccaacatgtcaactttacatgatctaacgacttgcggtaaattatagtatctatggtttccatgcggtgttattcgcggtgctctatcaaaccttggtattacaaccacagttcaagcggaatctacagagcttccaggcgcaaccttccaaatcaaaaccgtcaaccccaagccctgatgtcgctcagacatagacggcttcgaaccttatccagggcaatcaatcgtacagtatacgttcatcactgggaagcttggatgtcaatcccatgcagcactctggggatatatgctgcagctacaggtctcacgaaaggattgctggatgatcctacaaacatttgagtgcgggcatgaagaatacatggttttatcatttaaacaggtcactcgtatctcgaagtcataaatactgagtcagaccaatccatcgactatcgcccattcgtctgcagagtcacataattcaaagcctatctccccagaataacaacgattagcaaggctccttccatgtccgtgaacttgtgatgcaaccaccgaaagatatttccccggcggtgaaaaggtgcgatattggcatatcacctattgatgattggaaatcctgtgactcaaggactggggtgggcgcgtttactttggtggggggttcttgacgaattcgattcccttttcgatgttgcccttcaagcccttggtgcaggcctcgatgagcgtcttttccttctcagtcacgccgtcaagtacattgatggccttctcagccccgttggtctgatttgtcgagtcagagtgatgcccaatattcaaatatcacataatgaatgacttacgccaagttctacgagggtagagaagaactcgaggccagtggccttggaaatatcttcgccgccagcgataccaggcagatagacaaaggtgggctcgacgatacccgactggccttgcgcagccttgataacgctctgagcaaatcttgatatgaagttagccccgacaccaaatgtttgtaaatgaaggactcaaacctgaagccagcgtaggccatagacagggtcgcggagccggcaccatccttggccttgacaacctcatctccaccgaactgaacgcctgcatatggttcaataaacgattcaattgccaagagactgcacggtccacttacggttgactagcgcatcgtacttgtctgccgggatctggaaagcgggagcggccttgctaaagaggggaacaatagtctctcccgagtggccaccgacaactgggatgcgcacagcagatgggtccttgtggccagaaaattcctgagtaaaggtttccgcgcggacaacatccagagtggtaacaccaaagagacgcttggggtcaaagacgccagcagccttaaggacctctgcggcgatgggaacagtcgaattgacagggttggagatgatcaaaacaaatgccttggggcagtactcagcgatacccttgaccaagtcgcgcacaataccggcgttgattttgaagagatcatcacgagtcatcccaggcttgcctatgagcagcggctttgtcagtcagacgcctctaggaacaggggaggtgatacactcacgggggattccagcagggatgacaacaatgtcagcgccagtcaaggcgtgcttcaatccatcatccttgggcaggaatccggagattttctgccgaaaatgtcagaaagggtgtcaaattgtttggcataggggagcgcgttgtggtacggtcacacatacagcaacagaggagatgtgagaaaggtcggcagcaacaccgggggtgttcacaacatcgtagagcgcgaggtcgtcaaccaggggggatgtcttcagcaggagagacaaaggctaaccgatgggaaacgcgtggggagtcagtaaaagttgaagaatgtggtaggtctgcatcgcgggctgcagttctgatagggacaaatgagggacacgtacctggccaatgccaccagatgctccaagaacagctgtcgagatgtattagtgattagtctggggttgctctcgttctagaaagcggggtcgaaatgcaggcgccgtgaaagagccactcacccgctttaaccatggtgaaatttgggattgtgacaaatctatacacgaaggtgaagaaaaagcacgcgagattagtatgggtatcgaaacagatgacagagagtaagaagaggagaagaaaattgagggaaaagaagtagagagggaggtgacagtcagattaaagaaaagagaaaacatcaggggggaggggaagggaggggtttagttgaggagggggcggggtggtggtggtacggtcacggtgaacaggtcggggcaagtggcagagggattaggaaggattgggggatcagtagctcgatcctaggcccatacttaccagagtctttttttttccagaaaggagacagtggtcaagaaacaatgaaagggttagatggacatacgttatgagcaaatttatgtttcaaccgcatcgagagagggagaagcttcaggtccattatatactacggaaaccggacggaggatcacatgtggggttaaccatgaagctgtcctgctgctagactactagaccactaggctatgtctccagtgaccgagatccagcccatccgcgggtgtcccaaagggttcccggcccctcccaaatgacattggccaaacatacactccatttagtacactcggcaactttgaaaaggcatgtatttacataccccagtgggcagcaagtcgagtagagttgttacaattctacggaaccctggacgtccgttcaccatcccctaggtatgctctatttagtacatgatcctccaccatcaactcacgtagtccccgcgagctgacttttgctcaatcaaggccagagcacctcattaccatcaccaagtttacagggtccttgtggaacaaaaccgtcaggcacacgccaaatctttcctccgcaatccggacatgccatctttgccatgagagccggattgttgcttccggtttacggttgcttagtcacttctggagtcgttcagattcatcctcggatgtaggacccccatacacgccgccccagattccggcaattctcgtcgattccttcgttccaggagcccacaggcgaaaggaatataccggttcgaccggagaacccatcaaggtttcgggaaaaggcggatatcatagttgtctcacggtaacttcgcggttaggtacgtgcttacgacatcggttctacactctacttcggcccgacaggcggcaatcaacagcctaccaaaacatggccggtggcatcacaggcaattgcaggcggaaggctgattgttttcccgtcagtccgatgttaccactgcgtccaaaatgatgatggcaactcttccatccaccctccctttcttttgttgttgtgttgaatttcccaagatttttttggtttccattctgaatggcctggccggagaacaatgcccgcctggtagcagtattgctaaattacatagatgttaccgcccttggccagcacggcgctattctggtcatcccgaccagctctcatgacatcatgcttcctagcccttcccgaattgaaaagttggcatttactccgacttctcctcggcctttctggccttagcaccgcggggcttctgagcgggagtctccttcttggccttctgggagcggcggatggcgctgacgcgggcgacagcgtcctcacggatatcagcgcggtagccgttcttggcagtcttgtcggcaacacccttgtagatcctatgcgagagcagtatcagcagactgtcgcgcctccctcacggacatcacagcacgccaactgctcatattgacttacttgcgggtggaggcgttagggccgtaggtcacggtaacgacgttcttggcaggctgctgggggttgctgggcttcttggtgatgacagcaacaccgccgttctcggtggcctggacaccaaccgcctgttgttgcagcgttaaacatccaatccctgacagaagaatctctatggcatgaagcgcgggtaaagtaccttggtgttggcatagccggcgtactaagcaggtgatttgagattagcacgaaaacatgacccagaccttgcgttcagggttcgtaccttgaaagagtgcttgttctgcaagttcagggggtcacgggagaactgagaaccaccgccgctgttacgcttgaccagaaaagcattctgggtgcctgttgaggtagtcgtaacattagccggggaagacgaggcgcgaaacggctcctagggtttccattgggataatggataagatatgcgtaaaaaggtgctagtgacgtacgggtgagctgccagatgaggtcgctggaaacgttggcggccattgtgaaggtctctttcgaagcttgggtgggggatgaggacagatccaaatcgtcgcaagtccgttcggtatataccagctacgacttaatatctagcccttagaaggtttcagttgtgtgtgccaacgccaagaatggcaacgctgagagcctcgctaagcgggccgctttaggaatagacccattttcagggcggttcgttagatgcctgtgagtgctgcctgagaacgggggccgccgcatgtcgttccagccgcgtccgcaccctcgacccacttgcatcttccgcgctcttccatatgcgtacacttacgtatgacccgactgtctctcgttgttgtctaaatgcctcctaactagcaggccctggcaagacgccggccagactcgagtactgtacatcccttaaccctgtggacagttctattcccatcgctttaggagcattgaagcttggatctacgccgcgctacgctttcagacacctatatagcctaatccccgctgctgtttagcttgtccccagtgcctggtgaccctcgttgaccatggcttactaccttctctacttcctcacgatatcggttgttgtgtgtggcacaggtatgcgagatttccaacccctcagacttgcaagccgtccaagttttccttcctgacctgcctatagcgctctacctcacccggtcccgatggctacctctactgccagttcccgattacatttacgatcgtctcccctcgacttttgccggcgatgtggaagctggtctggtctcatcagagtttgatatctctgccaatattgcagagggcgacaccagggcgggcttggatgatcaggccaaacgcgaaatcttacggatcatgaaacggcgaagagtggatttcaatgaaggtcgtcgaatctacatggagcagcgcttttccaagaacaacatcggtcccgatggccgacctagggacccaaagttcgtgtcattctcttgatgacgtttgtatcagtcgcccgattctgctttgccctcgttctatttttcctttgacatgtgcttctcaccagcagactctcctccacttataccctcccttagtgaatgagtttgaagctcctttgctgcgcgtagaatttctttactattgccatcgaaatttagtcctggcttcccggcttgagattgactttatatcttgtgtcaacacttatttatgacttcgtggatcattgttggcaattaaggctcaattaccatacatgggcgattgaaatgctgtagtgtttcagttttgtatttcttgctaccacttagcacaaatgagatatcgagaactgtggacatcagggctggctattcagacacattcctccttcctgtcgaacgttaaagctcaaactagcatttcaatcttgccatgtataacaagcggatatgtcagtgttctcttgtgagttgatgcctctaaagccgttcaatatcgggcgcggccctcgttcttccgtagggcattgacagctactcggttgtgggtcgttacatcaagtcgagtagtcattatccgacaatccaagtaacggttgaggatgatgaaattgttcttttcaaataacccctcgtcttcggttcaagccaaggaagttggcctagaatgctcaacgcccgcgcgcatagccaggttgctggaatcccgggggcaacggaggtgggggaccaggtgttcctgccggtgaaccgaaccccggtggagcaaagcctggcggaggtgctgcttgagggaagggaggttgttgaccagcaccattgaatcctggtgggaggaaggactgcggcccgccatatccggcctgagaaggtggcggccgtgctggtaaacctgggggtgggttcgccagagatgtaggtggaacgggtcggcttgcttgtggaggaggtacgttttggaacggtacattcggaggagccatacctctgcccatatttaggtctggtggattagtactcattggccgagagctatcaccgttggccatcgcagctggcaccataggtgtccctgggtttgagaattgtggaggtagcggctgggttggtgggcgcacgttatgtttacgagcttgtgcagccagcattcgttctgcttcatcaccgtggcgttcacctttcccatctttcttataggcgtattgcacggagacctgcttgttcataagatattggccgttcatgttggttatggccgcgtccgaagactcaaagtcggcgaacgacacaaatccatagccctttgacaggttgttgtcatcccgcgcaatctagtagcagccatggttagtaagttcccctccgagacacggtgccgcatgacaggcctatagaaaggataaagtcctaccttggggatattgaccaggtttccaaagcggctgaatgtgtcataaagaacttgctccgtaaccataggatcaagattgccgacgaatagctctgccccaatctccaccgacttttgcttgtcggcggatgctttgttgacgcggatgggctttccatacaggcggattccgttcatgattcgtgacgcgtattcggcatcttcctcgctgatgaattccacgaacccatagccctgatgcgactgtgtgactcggtctttcggtaggtgaacgttaacgatgcgcccggcctgcagcatcagctcccataccaggctatctgtaacccgttcatcgaggtttccgatgtagacggtggcctctttgtcttgctccctattccagcaattgtcaggaccgatatgactgggattcatatcacatggagtaaagagaagcacttaccaatgccttgcgccagacatagcgcctacgtattactcttgaaaagccccctcggccggatgcaagcgaatgaacaggaacagaaagacgagggaggcgcttgaataaacaaaatagagacgtcgaattgacaagaaggaattgtgtagtcagaatagtgttgttggaggttagaaaaaggtactgggagaacaagggctggaaggatgatcgatggagactcggactccaggttatcggcggagcttttactgatccaactttagccccggaaaactttgagcttcacctcccccgtctttcccgtcactccgtcactccgtcaacacttccgcctttcctgatctcaactttaccggcatcagcagcaaggaaatcccttcttcatttccgcaacattcgcgtaagatttagccggcaatatggttcagttctccgaggaaaccaaggttagtctgcggtgctctgttgcccgtcatacataactagtcacgcttggtctcggtatgctaacggatatgcctactatctaggagcgtatctccaaggtcattgacgtctccagagttgctattcactagttcgtcgcatcttgattctttcgagcaatgtgtcctgaccaaaactgacggttatgtttgcataagtggatacctgccattgatcgtctatctcggtacgtgtgatggaattatttttcttgatggaaattttctttgctaacggaagcgggactaggatacacttacagtgaacccaagccttctctgttcaagtatgagcgactgcgccctgccgacgcttcccgacgattccagctcactaacgctacatataggctgttctcgccgctcgcctagaggaatgagttgcttcagcatactggacggcgaatgtccatcaggcagactcatgcaacgcctggattctccgtctgcgatgtagacagacaaataataatactgcctgtcggaatacgagcagactgagaaacctttttcatctcaaacccccgggtcgatgttgacattggaagtctacatcgatacacatgtacttttaaactatgatcagttctcatgttttgtattggttaacgcgaatggttcaatttcatacacaggtccagggcaggaccgaggatacatgcaaagggtttccgggagactacatcattaagtatcagcgtaagctcaaccgatgcactgcgaagcagactccagatcaaatatcagcatgtatgatcttattttattgtagtgaatagtcgtaggaaatgtctcctaaccatgcggttgtttccctcggacatttgggcgcttcggcccgccaagcgcgatgaacttgaatcttagctccagctcaaatccggaccgaatccggacctctttaatcctcccgacacttccggctagaatctcaaacacctgcaagcggcacattccaggaggactcgaagggttaatgactggcaaggatggcttgtcctcgtcctttgtggagaccgtagcgggattcacggccggaatcgcttcgacgctctgcctgcatccgctagatctgatcaagactcgacttcaaggttagtggttcatctctcgaggaagaagacaagtcgcgaagcgcggatcaatctccaatatttgatcagcattcaaattatgactaacgcagtatcaatctgccatattttctagtcgaccggttaccctcttcacgagtcggcggttcagtcccagtgattcgcgagatctttcagaatgagggcggcattaaagccttttacagaggcctgacacccaacatatttgggaattccacaagttgggcgctctacttcttgtgctacggcaacatcaagggcgtgatgcgcagctggcgtagtggttctcaagaccaggccctcacctcggccgactacttcctagcctcaggatccgcaggtacgctccagaagcagaaaagaaacagacctgcgatgttttctcccaagaaagcaccgggtatgcagttccgaagcgggagatgaggctaattcacggaattttgattctcacagggatgttgacatccgcgctaaccaatccgatctgggtgataaaaacccgcatgctgtcgacgggatcccagagccccggggcatacgcgtcgttcacgacgggtgcgaaggaaattcttcgctcggagggtattgcgggcttttatcggggtctggttccagccctgtttggagtcagccatggtgcacttcaattcatggcgtatgagcagttgaaactgcatcgctcccggatggctccttcggccggaacaaccggcgttcgacgggatgctgattggagccatgtgtcgtcgtcggacgcggcccggtcggggatacgggagctgggaaatgtggacttattcgtgatctcgagcttgtcaaaactattcgccgggtgtgttacctatccgtatcaggtgttgcggtctcgtttacagacatatgatgctcacctcgtgtattcgggcgtcagggatgccgttgctcagatttgggctagagaaggtatcactggcttctataagggtcttggccccaatttgctgcgcgtgttgcccagtacgtgggtcactttcctggtgtatgaaaatacaagagcgtatctaccaaggttgttttccaaccttcgatagaggggaacttgtctccttatctgagcggaaagcggaagcaactacctatcggacctgacatatgtcacacagctgctcggatctcgcgtccgccgggcccgtgtgcaggttgtatcttgtatggtctttgtgtataaatattcgttgaggttccagtcacctgcgatcaatgatgtctatttaccggaacttagcatgtattatattgttagttgtagcagttttgatataatcatacggatcaacatgatgagaaccagaacatactaaaaagactttgtccaccacaggtatatatgtccaaggaaagggatgagaatgaaaggaaacacgctgatgtacataagaagagtctttaagccgaacgaaaacgtctgtgaaagccctaattcacgcgaacaccatattcaacatgatatgcgggaagtataaggcagataaaatcaacacgaacgagactggtatcgtaataacaaaagaggggaatgtggatgacgcgacaagattgtaagaaatatgaagaaggccggtatatcaatgagcctgcctctcaataaagtatggttctgcgtcgtcgtcatcgctgctagaacctccgttatacatagatgtatctccatagcttgctcggcgcatcttgtcatcagtgctgctgagtggctcgatccttctgcgggattcggagccaggatcagaccgtgaagtaggcgagatcctgcgatctttcccgcggcccttgattcctttgttgctgttcttatacaaagtggcaaagtattcccagagctttctgtcttgtgggctcatgtgatctccctctgtcacttgggagaatttcatagtaagatttcgtagggttgtggcatggaacttgttctggtgtgactgttatagcagtcagctatcattgaggggattggtttcggggttgatgaattattggtctccgcaccttaaggtttccaagctgggtgaactgctttccgcagtcatccaggagacaagtgaatggtttggcatgttgatgggtgatcttgtgagcacggacgttgcctcgttgagcaaatcgtttctgacatatatcacaagaaaatggcttttctccagtatggcgtcgttgatgagtctaattatcaattgtctctgttagacggcctgcaacatcttcaatgctgttgatgctcttcttatagggggcttttttgccgaacgtccaataactcaccttcagattacccaactgagagaagcgctgtccacatgaaggctctttgcacaccttagcacgaaaggttaggttagcgtcatatttcaataagtgtctattctcatgccacctacaaagggcttgtcccccgtgtgagcccgcatatgaatatccagatgcgtcttctgcgcgaagctcttgccgcactgcggtaaagtgcaagcatacttgcgttttttgcctgatcgcgatggggcttcttcgaccataacagtgcaccggggggtcgtcaccggcattgaataactctgagggtatccattgcttcccccgtgtgtcaattgttgcagtggcggcagagactgtactccgggtgactgagcactggctttggcctggattgccttcatcaagatatctacctctgtcgagaattccacctcattggagctggagctcttcccttgtgcaccttcttcgttactcgaggactgggccccgggaggttgctgtgacgccccattgtgctcgatcttcatcagaggatccctggctacacgattaacagcattcttggccggccgaatatcgggaatttgctggatggatggcggctcagaggatagacggaccggctggggattgatcggctgctggccggctacaaagtaatgctggtagcccggatgatggtggtgatgatggtgatggtggttgagtgtgtgtccgaagctatacgctggtgacgaagattgatgaaacggaagtgtatagccaccagtcgggttggtataaaatgggaagttgtggccgacattcgagcccatcattcgacgaggcgcaacagccccaacggcgtggccggggaattcgtatgaaactggttctgcggtttccatgtcgacaaactagcaatgaaagggttgctggactttgcgttctctccaccactgggccttaaagagccttcaactcctaccgagctgattgcaagcgtctgaaaagcaagatgagcaacggaacagagacagcaagatagtccgatgggaagaataggatactgcctgctatcacgtctcagtaacccatctacaatgtccgaaactgtcctcgcggggtaagtcttgttgatttgaaagactttgtcactcacccactatcttcgaaagacagggcccacgctgcttgttgatatgacaccaagcaaagggagtttatgatgaagtaaagaagcaaacaggtcgggaacaagcaaataaaatatatagggtatcaagtcaagatcaagatcaagatctcaaaaagcaaacatcagtatcagcaatggaaatttgagttccccacaagctgagcgtgtctctgagggaagaattgaccagagtggctccagatgtatataaactcttgagtagggcaaggaagaagaagagtggagagagacaatggattgtagccggcagtcgcaacgaggtgggctatgacattgattttgacaatgggggatcaccaataagcaaatatacggcttgattcttcagcctgtcttcttgggtaagtttattcggcttttttcctttttctttttttccccttctctctctgtctttcccttattttgttcgggccgtcttgattccctttaattaattcctcctactttatttcttgaatcagaagaacagaaaagaaaagcaacataagaaaaccaaaaaaaaaaaaaaaagaaaagaaaagaaaaaaaaaaagcaggggaaaaaataaataaaagagagtgaaataataaatataatcatttgcattggttggtttccttggaccctccggaaagattgaggacggtgatctagaactaaactaccactaccactactagatatacatcgctagccactcatccaccctccctttctcggtgtcccagagcagtggaagcagcggggtggccagtgacagggatctggcctgctagtttagttggtgctgatcaagctgaaggcttgtacgcaccagaataggaaaagtaacaggcagctgaggtatgggggtgtggataggcacgtatgactatgtatcattgtatgactgtatggggctgtattgaaacaattacgtattggatgttatagatgtacgacagcacttgtcatggatgtattggatctcaatacgaagtgcagtaaacagaagaagcctctcggggaaaaaaaagggggaggcaaaagatgattgactgaatggatgacaggctaatgacgataccatatggatataggaaatacatcggaatttgaaaaatagtcatcgggaattattctctctctctctctctctctctcgatgctcacggtaagatcgctcctaacagtatgtctggtttccgagaaatctccccccgggtcaccgaaatttggggcaaaggtcacaataggttactttccactccgtcttgtcatgcgttttgtgattgattgacggagctgaatgcaattattctgaatcgcggttgccccatccatgtacattgcaatcccgaacacccaagccaccagagaaggctgacacatcttacttgggtcccatgaagttccatctggtcccttttcttctaaccggagaatggggcgattaattactagttccatcgacaatcatactactccccctcccataatacgagcatgttcataaaaatgaagaaaaaatatttatacctatataagattttttttattttattcttggcgagatacctaacttaaaaagggaatccatggatgggctcccgggggatcggggtccactcaattttcgaggagcccttcagtccaatcgcggaaggcatgaagacattccgatcgggctgacagtcacgcaccacatggatggtacggaaagaatacatgctgtgtactaggtattgatcgcccataatcaggactaatgcactttgctgccgactcagtctacctcaggtgtgatgaagctgttcatttatatatatatatatatatatactatatactatacacgcatagtagagatgtttgtactattcacccccccagtcacggtatcgcatataattagtctatcggggtgaactccatagtaacacactagacatcagattcaactggtatgatcgagagttccggtatccctaattagtagtaatcagcagtaaagcggataagcatggcgaggcaaccataagtagagctggcaatgccgccaccacccttgagataggagagaagaacggcaaaatcccaggctaccataagcatggattgtgaactcgtaattgacatcccacagcgcacgagtcgtcatatcatctgaccccggaggatggcccatgggcattgaccccgactaattcgaagagtgagtggagtatgggcatttcttctgacacctgttagatacagctgatgtagtacctgactagtattcctatgtctgaactggatgatcagctactagatgtggtctttggctggttatggttttttttggggggggggaagtttgggggtttggtgagagtacgccgtacatcgcacttactcggggaactaatgctgctcgacacagctccattaccattctcgtatctttccataatgtcagccagctacttactagctgttagtgaaacaaccaggataccctcgtcatccacgcaggcacctgagctgttgggatctatttcaacaaatgggaggcgggttcataccggacaaccttgccggtcgaaggatcttcatcgtcacctggatggatgtagatcttgcgactgggccttgttgcccatgggggttcgctcatggacccgtaagcaaagatagccactaaccggccctaaggctccctcgaaacttattccggcatccaagcttaagagagcaaagaatggggggggaggaaggtagaggctatgtacaaactacataatcccagcacctgcatctacactagggggtgcttaaggggataatacggctgtcggtcgtttggttatacgcggcgtgagatttccgcggctgcgaggcatggaaaaccccatcctattgatatcgctacccggttgcaggagcgggcggtaattttcattctggatgctggttcgctgccggagcggccgagaactccgatgacgggcttaataggagagggagtaagtacgtacttactgttattatgtatcggaggaactggctgagctgaattgtcctccatccatccttcttgtcagtagaatgtgccccatccatacctaccttagcggcaagtaaacatttactagttagaccttaggccattgctcttacctacttagtcacattgtcttcactaaccttttcattaggtgtgagtttcaatatgatgattgatatgattgaagttaaccgacttgttactacttatacaatggtatttaggggagggagaaaaactagaaaaaaaaaaaaaaaaaaaagatgtgttatatctacggaaaaagagacgcaacatgataatacctcagtacttctggtcaggcgagagaaagcatgacagggttcgcccggcagagctacacaacggaccgctcgcgggcgatcaatagtgtagcaatccccggccgctcatttgctgtcaagctccccactgtcgccctcctctccttggcgtggatgtgcctcacctttgcaacagccgcgtctggcgacttggaaatcccaacacatcccccgttcgtcctaccgtgttgatagacaggataggcccggtaagctagtctcactggtcgtcagttgttcaggataaaggctagcaaccctagaaataaaaaatctcgaaccgatcagtatccggagtaagacataatcgggaaagtgaacgatctcaatggttcatggcctcgaaacaggtcttggctactttagtccagcagacctcttcctgtcttatcaaaaaggtagataccagtgagttgtcttcccccatccatgacccactccactttgactcttttcttagcatcaaacgatgcatcctctgaatctctcatggaacatcatgtacttctgtacgcctttacccctgaaaaagtggattcacctccaggttgaaacatgcaagactctgttgcgcgctggtgctgttggatggatggctgacacgacttaaacagtaattttaggtgccaatattgaactagactcatagcatcactgaccacaagaatgttggctatgactctaggtaattcctctctgtcggtttcttcttctctttctacatttcaccttgccttcctcgttttggttcaggcaaaattagtacaggggcgagtaaggttagaaagtagggaacatgcttatgtgggtactgggcaggtaactaactatactgaggtagtgcagattgtaaagtgcctgacgtatcgattaacatggccagtgctttccgtatttgttacaagattgtatttcaacatttctcgaaatgaaagtaattgtggtttccaaagttcgccgtcgacaaactgtgtccgatccctcattgcattctctgcctttttttcttgattctgtggaacattgaattctctcgcatgacactgaagtttcactgctcagtgtctgatggagcgagccccgctgtcattgaacgatcaatcgggtttagagtcgctgaacagagggttctttttattttttatttattattttttttttctccttttctctctcccttacagagggataacactggcctatcgtataactacagttgttatgaaaaggatacaggagctaaaaagattgtgatttagatacatatgacgatggtgaatgaggaattgaatgtactctgaaggcgtgactttttcccttctccttacctgtccgctgctgtgacgggccgggccttcatttcggaaccgcccaaactcagccatgacccgtggatcttacaggtgatttccccaacccctttaggtcacgctaatttcatggaggcagaacttttgacttagtaccaatcccaacttaatagggtcttgaggtgaagcctcttagaattcacaccgtgctccagctgaaccgtgctcctccactgcgagggatgctggtgccaaggagctataccaactactccgtaccatgtaaaacacttattcctggcctcatcgatcgtggacagcgaccactgcgttcccgacaatgtgggcccgaagcccaaggatcccctagtgaggatctattggattagactgcggcaaagttcaaacctacttacatacagtaaccttactgcacgggctgtaggtaccagccagccagccagccagccagccaaccagacatacctacataagcaggcatacttgtggatacagggctgttatcctttttcttatttcattcttccctttttagggaaaatgcatggatgaataagaactgaaatctaagaataaaaatgttataacagaagaagaaaaagaaaagccctatccgtcgcgttttcagatcgggtgaggggagtggtgactcgcacatccataggcacaactatcgatatctcaaacatgggatctaaaggagttgcgaaagctgacagtcgtgagatgtatcacatttatggtttcatgcagtgtcaggagataaaaaattgagataatccgtgacatcataggaacttctactggccggatttatgtgtctttgcgaattggagattcattcacagtctttttcttttttggtaaaaacagcatatgttcggggattcttgtttttgttgtgcgcaggcagtaattagcattgggtacttactactactccgtatgttctagatgtccatttccgtgaagtcccgggatcgtgaatgatggttcatgcatagtctgcatgtatgtaccatgatgatacatgttaaaggtatgtgaacacagcagcttagctcacgccagtctagagctagccgaacctgaccagctccggatttgtgaggattattagttacctagatactaactagcaggcatgcatgaataagtttaatcatggtaattcattctgttacaacagcattcaagtcgtctgtcaaaggatccagcagctcctgaagacagccccagtgcctgcccccttggtccatttacccgccaagacacaccaactctgttccaccttcttcccccttcccgagcgagatccgccagtcgatcatcacggctcctgctcgggaaaaagaaatgagggaaaagagagcccgggggagaaagtcagatttgacaccccacggcgatataggcgctggctggtgcctgcttgcagcacgtaaggcatgatgtaggtcgattgcccaatgcacacccttcaccacctcgtgatcgcagggggctgcttgtcagaagacgcaggagagaaaatcgcgtcccatcaatagcgccgactagcactgcccgggtctgtgacaaacaccagccgagtggaattcgactcgtatcgcgccggtaccttaaaatgtcacatacgtgaccatggttttgcctcgacttacagagggaagttttcctgaacttgcagttcacaatgatttctacttttctatgtcattacaatatttcagacacaaagaatggattagttgaagtgaaagaaagagagtgagagagagatatatatatatatatatatgtaaaggctataattatagagctgattgcgaggggggctttgggttcacgttcacataatttagctgctgtgtcaagaggcaattgactggatactagtactgccgacttgggaaaatcacgccttgatctgttgggtaaatacgggctggcttacttactttaccactaaggttacgtgacattatccccgaaggaggaaggaaccatcggccacaccgcatggactggaaaatcaggaacgggaacaactgacggggcagtggagcaggtgcgaatggatccccggaatcgagacatcaattctctagtcacttattaagtaactattaactaatccactaactaacccacagtaggtatccctactaactacctgactagtagctggttatgcctgtgccatcttttactgacctataactaatctcacctgctgggttgtcccatgccaatgcagcatgtcgattcccatcacaccgcgggcatagcccaggcaatggctttttccgggcccttaccaagcctcgtttaagtcgactgagatggacatttcgagtgggaacagtcccagaaacccacaaggaggagccatttagttggaggatcgtcatccgcaggccatccagattccagagctccttccccccactcatttcctaccaactacgtactcctactactaagcacgatggagtacagccctgggtgatcgtgactttaccgattgctatccgggatctacctgccttgcttgccctcagatcactggagccatgcccggtccatacctcgtactcactgcttattcacctctacgggtttatgccgtttacgcgaaagacgacgagacgagatacgcaggcatagcatagccatggcgatgcacgctttcaatctgaataatcgagggctgtcactcttcatagtatagtatgtagaaggagctttgtgctgaccgtcttgctacttgctaatcacaatccaaatgtcttgtgccgaagcagatcctgagatccttgccacatcccgatatccaactccatttagctcagatgctgacggaaacctatgatcttcctctggtggtggcggctatgccagtgcctcaaaaatgtccggtacacctgctgtgcttacttagccttcccggaaaagtccgtgggcccgaccaactagataggtatcgatctcgctttagacccatagatccccgagtggattccctacggaccacggagtttatatattctcgatatgggagtccaatgcgatgtacgccgctactgcagttcttcgtaatgcgagaacataggtccgtgaccaattcaacaacttgcatccactaccaatgctagttcaattccgagagattgcatggcagcctatgccccttagtgacggcactgccagctcttttcctggatgtccaagacaatcatagttttacgatcatgcatttatatgcatggtgaccgaatagcggtgccgactgctgattccacccccccgcaacgtgcaggtgcccgtaatggggactacggatatcccgattgaaggtgatcttacgggtataggtagccagagaagtacatccctgcgctcttaaatggctactttgtcggagccagcaaatcatgtggaccatgaagtcaactgaagcatcgggagggggtgattgatcttctagccgactacaatatgccgcagtcaacaagcccactggattatcattatcgttgtctctgcacgatggcaaccgctaaggaagcatctgccccccaccgatcatcacactgctctcgtgacaattgcattcagcttcctcagaataaattcacaaccacaaaatcagcgcgaaattactaccagtacagcctttttattgtattttgttttcttcctctttttttgtttcgcttcgcttgtagcagttcgtctcctttgaaaaaaaaccccccaaggtcacttccccgtgcatgggagctgtgacaataaaagcaattggccttttgcaacgcaaatcccggtagtgacgtcgaacaagacgcgacaagcagagagaatcggaaacggaagattcgaaaagaagaaacataattccataattgcgccaaaactttcccaaatcattctcatcaccgtccagtgtaggtagagtatctgttcgagcgaccttgtcaacaatgctcatgatagagaagaaggaaaaagaaagccaccaggacaatcaatgccttgtaagctagtaaaaacgtacctccagattcttgcccgcatgtcaccactgccagtggcaaacaggttattagtagggctgggcgccacggagatgactgtcaccgagttagcgaaaaccaagatcacctagcaagccagacatggtgctcggggggtttaggtacgaacctgagttcttgtgtccctggagcatcatctgcgcatttccggtgatagggtcccagaactgaacgcctcggtctttagaaccgctcatgacccaatgtccgtcgggtgtcaggcagacgctgagcacaaagtcctaacccgtgaggtcagcaaccacgaaaccagtatgggtcttttgctatcggaaagtatgtacttaccttgtgaccttcgaaagtgcggacgcatttaccacccttgactccgcttccggggtaggcgccacggggcacgttgagctcccaaagtttgatggtcttgtccagactaccactgacaaggtcccggccgttgggggcgaaggcaaccgagtacacgctgtccttgtggccatcggggctctccaaccgttccacaaggtagccggtagtggtatcccaaactcgcacactcttatcgagagagcctgcagcgacatagtgaccatctggagacatagcaacggtggtcacaccgtcttcgatgctcagggtgtagaccaacttgccgtccaggatatcccaaaggcgaacagtcttgtctccactaccggacgcaatgtaccgaccattgccagcgaaatcaagagagtaaatatcctgttcgtgaccggtaaagatatgcttaatcgtccgagcattgatgtcccacacctaacggtaaaaagaagaagaaaaaaaaggttagcctcaacagttctgtataacagcgcaccaaagcggcatcaacgatgacgagtgatgttacagcgggaccacatacccgaatctgcttgtcttcagcgccagtcgcaagatacttgccatcagggctgaagcagacgctgcgaatgtaaaggtcgccgttcttgtccacattttcgtcctgcagcgtcgcaacattctgacccgtggtcacgtcaaagatctgcgcagagcgattgcagccggtcgcaaggtacttgccgtcacggctgaaacgaacacagcacacaacgctgtcgtggacaaggtgatgaacaagttccacatccagcacgcgctgcacctcaggattgaacacggcataccaatcggcgccctctcgcttttgcgacgccggcagatcgtcaggattccaattggccagcatgtttcccggacgatctcgcacgagggcctggctaggaggcgtggggcgggccaattgcggcgaggagacgcggggatcggatgtgtaggccagctggtgggtctgttgaggagtggccgggccgggaggagcacggggccgcttgccagggccgggggaggcagcaggaggagggggaggtccataacctgtttagagatcgaggcgatcacgaggtcagaggtcaggcaatttgtctatcaaacatagtcataacataccgttcacagcagcaccaggctgatatcctccaaaagagctctgcggtggttgcggcgctccttgctgggccgcggcagcaggctgttgaagggtatgctggggaggctgctgatcctggggagggggaggggcaactggaagaccggggccactacctccttggttggtcatgatgccaccaaacagattgctagggccgtgacccagggccggtggcggagcctgagaaggtccagcgtgctgggccgggccggcaatgtgagatgacacgggctgaacaccgcgcgattcaagctcatgtcgcagcacccgaatctctgcttcgtaactacaacaatagataaggcgttaattcggctatggggtaggatgagccgccggggctcaagtcacgtactcttgtttcatcttgagttgtgcctgttccagttgatagaccttctggcggatcatctccatctcttgaagctgtccggttactagggacggtagaaaccaagggtcagcaatatacaccaacggcgggaaaataacgttagatataacaattgacgacacaggatgctctccattgcattgaaactccggagttcacccgtacgccgttaacctgcgccacaaggtgcaacccaacggaaacgcgccgtaacaagcaagccccccgtcgcaaagccaatccaaagaacacaaaggaccagggaaatatcaaaacatacgctgatgttcgaactcgccagtgcttcgagactgattctcgaattcctggcgcagttggtccaacaactccgtcagacgggagttgggagccggaaccattccgcgatgagtgttatacatagcgcgaaagatttgtgtcgttttaatcccgtgttcacttgaacaacgatagagggggtagacaatccgagcaacgagacgtggaacgaaagtcgcttgggtggaaagtcagtggtggtggtggggaaattggttggtggtcgaccgaaggggtaactagttcaacggcaagagtaatccgcgactccgggagaaaacaagaaaatatgggcgacgggagtcgctgttaggcgacagagactggtgtgaggaaatcgatcaccgcagccgcatcacagcgcgccccctgaggactcggcgcggcaacgtggtcggaaaggggaaaacagcagaagaaaatgaggggaaaggatgttgaatgaggataaatgcgcgtggacgacgatccggggcggacgatggatgaaaggcgagacgatgaaaggacgacaagggaagaggggaaggaggagcagaagctgaggctgaaggaggaggagagcgagatgaagtgacagttgaaggtccgttcagttcaggttcgagttcgttagtctttcttaggtaaggttcctccgggtcacgctcggctgttccgggtccggagaaccaccgccacccaatggacgtgcccgttttgccgcccgaagcgagcccatactatctacatactactatgtatgagtttgaaattggaagtatatactcaagtataagctcaaatacatatggttctcgtagaatagcggaaaaactcacaattattacacagtagtttctactatattctggggtaaagctgactaactcactgtcgagagaaaagaaagagtacggcgcttagtgtgaccgtattaaacataaacttctctcccaaatgcagccatagccgccgcaatactgcaacaatacagaaaggtttgcaacttgcaagaacgtactgaaccataccatcccgtgaccttatcagatcaaccggaatttcttattcttcccaacagaccatataacgttggaaccttctattgttcctttcggctcaacgccttgttccgcaacaacccccctcgaatattgtattctcacacgcccaaaacccagcaccatggatatcgccctcgaaatttgggacacctttattggtgatcgtctatacgcctctctacttcctctctctcttgcctcatccgcctcgctccccggcttcactactgtcaccaacagcaccctgtcgttctttggtgcaacccagcccttcgtttacgaaccggctactcaattgatctacttggagccttccaagtttgcctatctgagcgcctggccaaggaacaatatctaccgtcaattcctcagtttcttcttgatcgtctggtatgtgcgcttgtgttcatttttctccggtgttgtcgccccctccaatctttcctttggctaacagggtgggcgcattgtttgcgcctggattaggatcttcggtatcatcgtctacttcatttccgcaagtctatcctacatcttcatctgggacaagaccaccgttcatcaccctaaatacctcaagaaccaaattcctatggagatcgcccagactatgcgctcaatgccggttatgtccctgttgactgccccttttctggtcgccgaagtccgtggttacgccaagctttatgataccttctccgacgagccattcccctactacagtattatccaattcccgctattcatcatgttcaccgatctctgcatctactggattcaccgcggcctgcaccacccgcttatttataagaccttgcacaagcctcaccacaaatggattatgcctagtcccttcgcctcccacgcttttcacccacttgacggctggtcgcagagtgtcccttaccacgtgttcccgttcatcttcccgctccagaagctggcctacgtcttcctcttcggattcatcaacctctggaccgtgctgattcacgacggcgaatacgttgccaacagcccggtgatcaatggagcagcctgccacaccatgcaccacctgtacttcaactataactatggccagttcacaaccctctgggatcgtctgggaggcagttatcgcaagcccaacgaggagctcttccgccgtgacacaaagaatggcgaggaggaatggaagcgacagaccaaggagatggaaaccattctcaaggatgtcgaaggcgatgatgaccgggcgtacctggccgattcacagaccaagaagaacctgtgaagacgacaatcatgaccactcaaaaagggaccttttcacgcaggttatacgagattgtctctgttaccgggcccagacttcatataacgagttcatggcttctccctaattttcgaccttctcacgctacgccgccctgactacgtcttgtataacacggattctagtatattaattgttccagccacctttatagacgtgtattttaattcaaccctgagtcactggttatgcccctgcttctgaaggaataccggaattgtaccggccagttgtctgtttggtttgtttttttcttgtccttttgctttgtacatatgatcaatcgacggaaaggggagcggaggtttcgatactcacattctaatcatttcctgcactacgctaaatatagagaggtgtagatacaacacctaatggaaaggcagcaggaaaatcccaaaaaactcgtgttagcagaacataacgagaagattcaatggaataaaacagttcctttcttttcttttctcttcttctctttagtggttttatcagagtctttttgctttttagtttgaacgccctcacccgctgaaattggtcgagataaaaacaagtgccacaacctaacttatgtatgtatacagaagggggaagagaataaatattagaaatcctggaactgaaaattgaacatctcccgtccctagcacatctgagccgattaaagccaatcaaattcctcccccgctcattcgatgtccacgctcgcatcggcttcagcaatatccatttccccatctgccgggatactttcagaagcggcggtctcttccggagccggaggcggagcgactgtgccgacaggagtagctgtggccatggcatccgcaatgaacgattcctcgacgccggctttcctgcggaacactctgagccagcgctggccccattgccggatgatttcatcctctggcaagtttccacttccatctcctctttccatctgctcgtcgttgcttccgccggccactgagacgatggagtcttcgatgaccctgaaaagagattgcatatcaaccctctcacgactgagcgtctcatcgaggacgctgagctgcggctcgtagagacctggctgagtacgtgcggcaacaatctggcgcaggcggttggtgacctttccgactgtggcggagatcatctcgaaaacgtgagatttggcaaggacggttcctgcctctagcttgtctaccagtgcccattcaatgactgacagcggggtcagaatggtgtagttgagaagcttgtcaatgatgttgattccgacgccaggctgatcaacccaatactccatgacggaggttatgatctgacgcctcgcctgtgcagattggggcccgatggccaggagtcgttccttgttccgctcaatgcaggacagtacatgagacagagacttggagccaacaaagcagatagccgtaacaaaggcgtccgttgaaggcagcagcgggtcttcgacaccgagagatctggcttgctcttcaattgcgtttataagtggctggatctcctcatcgctagccttcttgcggaccagctgcataatttctctgccttcgttggcatacggagtagctggacaaacacattagccaattgtcttgaatccgagccaaagtcgagttgttgaagtagtaacaggaaagagtggacgtgaggcgaagggtagaaaaacttactatcagacgagtacttgaaatcaggtgtgtctttctctttcccttccgtaatcaagtcttggtatgggtcagggagagtgcccctaatacgctgtgcaaagctcagccggatctccttgtcgagggcaccattgataaaagccatcctagggtgaaccagaggcagctccaagtcatcaatcctaatgcgtggtcagctgatctgtactgcgtcctgtatgtgcatatgccttaccattcactccatttccaagtgaacccaaagttgctcaagtgatgagagaaccaatccaagaaacgatggcttaggtccaaatctattgtctccaggctgcgatacaagaagcgaatggcacgtcctaaactgggtgcgatcgcggccggggcgatcttacagcactccgtgagaactgagtggtagtagaccagtttgtgctcgggagacggcagctggaacagttgggagaacacggcgtccacagcaacatcctctggtttccagagattgatgtctcctggtaaatcacgcagcctatcgaaaggagtcgctcgcttcacgaaggtgtgtggcgtgaaatagcagtcgacatcaatcaaaaacttcgccgtcgcaatgcggttgaaatcaagaatgttgatggtatcgacgagggcatcacgcagcaaggaagatgcgatatctgaagtaggagggactgtttccatgtcttgatttgcgtacacggaaaggtacacctccggaaagattgctcttgttccattcttcaccggactcggaacagtgatctgggggaatgcatgctttgggccgttttcataagccttcggctctgcgccattgtcctgtgtctcttgcccctcttgtgcttcctcgggctcttgtgcatttagtgcctctaatgctcctctccatggcctaggaagacacgcgagctcccaaccccggccggactctttttgtaactgattctggagtaggctaatgacacttggcgtggcaattgacttcccattctccaggccgaatggattaaccaggtccacaagagtatgtggggtggaagcgatgatgtctgtcttctccagaagtgcggtggcttgggactcgaaaccggctgctggagaggccataacgtacggaatggtgaagagaataattttcaccagctccagaccgatcaactgtatgcgcatagttagcaaacctgcgatccttgagaactgtcgggataccggcgtcgcttacatcttccgaggatgctgtttgaaggtcgacagcacgcgcaaagagctcctccagtatcgggaagatgccatccccttcgaagacacattggagacaacccaggaaccgcagaagaagcttgacctcgcgccacgcgccagcgtcaatgtacttctgcaagcacacgcctgacttgttgagaacgtcggacacgagctcggatttctggaagtttgcaatgaggacggtcgcggcgataaaagggatctttagcggctgctccaaaacactagtataataggaacactattagctccaagctatgcgggatttcgaacaggccaaaagggggacagccaagtcagtcaagccatacaggtcaagcgcaatatcgacaaacgagttcctgaactcctgatcttcgtagttgtctgttacacttcttgcgatgcttacagcgtcgtcttctgctcgtctggcagcctaaagaacgttcgcagtgagctacagcacttgtctcacatattcgggccattgaaaaagggtattcgtacagattcagcgatcgtaagcagttgcctccggaccttgacaacaagcggctcctcataacgacgcctctggcggcggtcatagtcatcatcttctgcagtattccaagaaattgttaatggtaagtggccacgagggagcttcatctataagccataaccagagtctggggggcatggtggccattggcaaacaagcaattgaagccaaggactcgatcacagcaggattgcgtattttactgacctctgtagcgcctcttgcgcccaccacccctggggccatgaggccggcgttcgtagtcggccatcgctagcgggccttacgtccacacgagcagtcttgcgcaacgactgtctctagatgatattgggagccaattcaagctgtagccagcacggcttctaaggacagcggcagtgaggagctctttagcggtattgccgtcgcgataggaagggcatgtgtctaaggaacaaaacatcaccaatagtgctcagctgctggtcgggactcgggatcctccgtcccgctgattatctaaccatgttctttctcctgccttcacagccagccagagctccagtggagccgggggaattgctgcgtgcaggacctgactactagtacttactatacttaactacttactgctccataagaaggtcctaactgtgtcgactacgccacagctacggggggcaaaggggagcttgaatgggaaggaagtcccacagcaacatttgaaaacacaaagtaatacccatacgtgtatatgcttccccagtaaaacataagagcaaacttgtacccatagaaaactgcaagcatgcaagctagaagaagtcaagcaaagggaaaatacagaatgctgtggttatacacagttcgagaacgagagtatccaggcaaagttctttggggcctctaagatgaatgactaggaacagcagcaagcaggtaaataggtgagtcgtctgctctgggaggttagagacagggaccagatagcttcatggccgtcaatgccaagtggacgaggctgagaagaggagagaaagggggagtaggccggagaggtgaggttagaggcggaagggaccacaagaagatgaaaacggagacaaagagatatagattcacagcagaaacagcatgaacggggcttctagcgcggcaagtcgggaaagaagacctccaatacctatattcaagcacactgacaggcacgcggtatggcgcatccaaacaaagaaatcctcaaagatatctgacgcatttgtaggatattcatctttccgcccttgtggaataaacttgcggcaatttgtgaacagagcccgttcgatcgagatatgaagctatgcagacttgatcccggaaggcagactcacgcaataagggtatcacttttttccctcccaagagctgtctcagacacctcagtaactccaggctataccatcgcgtcaacccctttgcgtgaaacagtcatgatccactaaaacctcccactctcaaaaacttttctggtcatcaagagccacaatcttctctgcgccacctactctcccagagatccatcccctctcacacacgcacactccctctctctctcagtacaacctctttctttttcttttcgttgttttttttcctctcgtttttttttgatggggtattttctttctcttttctctcttcaactttctttctcctgctcctcatgctcacgtttcaccctatctttcagtattctgccatacagaagccagctcccggatgccccagcctatggattaggtctacagatttgaataaacctttcccagttcaagaaccgcctgatgaatgaagataagctcgtagggcatgacatcaaatttccgcaatcaggtgcaaatatgtttgcacacgtaagggcgtgtagttcgtcagattcgcgcggtttgactcagtcaagacgcgctatcatttcttccttcgtaagaggcttgaagttggtgatgtctaacccgcgagcctcaagtgcaggacgtgcatgaggaggaatcagccggctgttcatcgcgggcgcaatagagagttctatgacagtgtcaggtcgtcagtatggggggcagccaagagcaaggagttttcaggaagaccgaccatgcctggagaaatcgaacagattagggagctccctggtagagccgttcgggtgccgcgagtcgggcaaccgggtgttaggatcccgaagttcgtcgaagaatgggtggcacatcgcttcaattgctgaaagccgttgcgtcggtgtgtattccaacagggcggagatcaaatcgatagcctcatggggggccctccggaagacctgaaagacatcagcaatttgcagtcgaaattatttccacgaactggtcccaccttattgaaggggtgtggcttaatctgcgggaacttgtgttccatgtagttcgggttcatggtgcgaatctgctcccgcgtcggggtgcccagaaccttgatgatctccacaagttggtcgatgccggattcgcctgggaagagtggttgtcctagcatcaactcggccatcacgcaaccagtagaccatacgtctgatttatattagtacgtacgcagagcccctagattgaacttgagaggaattaccaattttcgtggtgtagtttgttgcgccgaaaatcaactcaggtgcgcggtagtagcgggagcaaatgtatgaaacattaggctcattctcgacaagaatcttggcggatccaaagtcacacagcttcagaataccggtgttcgggtcgagcagcaggttttgtggttttatgtcacgatggcagattccctgcgagtgaatgtaggccagagaacggaaaagttggtagatgtagagcttgacttccagcatcggcatggttgtcttcaacttattgaaataacgcgatgcccgatacaccgtctctggtacatattcgaggacgaggttcaaatacacttcatctttctatggcatttttgtagcatggtcagcagacaagtaggtggaacgacgagtaagatgggatgcagcatgaactggaggggtgggaagtaagaggaaggcaagcggtgatttaacggagagcgacataccctttctccgttagagtagtaaaatgccttaagttctacgatattcgggtggcgcacgatccgcatgatctgaagttcacgattctggaggggctgttagcgaccgggtaggcgatgacgagcattggtggcctcgcatactttgaaccgtttgtcctgaagaaccctcttgatagcagcatcttcgccgctgggcatcatcttcgtttggaagacgacgccaaaggatccattgccaacgattttacattgtgaataggagatctccttggtctctcctgtaagtccatcctggactttctcgcgaacgacttctatatgagcaagaacaaggaaaaggttagcaatcgagtccaccagatgggcttagcaacaattgcgttaagaacggcacgtctcttaccacccatgcgcagactcgagaagaccccaggtctattctgtgacatcacggacggctagtggggacaacaccgggcggcaacgtgggcgatgctatcgagaatatggagggctggacttcaacagcggatgtcggaaagggacgcaaaagtaaggcgtgaggtccgttttgggcagactgtactcggtggagcactagttgggaggggtgctctggatgggcggaatatccgaacggtggatgttgagtggaggtgcgcgtgagatgaaaggttgagaagcaggcgggcgaatcgtagaagggaaggctcagaccaaggggaccaatggacttggggagcgtgccaagagttgcagacacaagacctgagcaatgaacgccccaaagattgaagcgggtttcctagatgagggagggagggggggcggtgggtggtggaggggaggagggtttggatagaagaggggacaaatgtttctcgaagagaaaaataaataaaaaggaaaagaaaaagaaaaaggaaaaaggaaaagaggaaaaagtgaagttatgtgtgagaagaaacagcagcagtagcaagtagcagtttagtagtttaagagtaccgaaccgcagctgattcgaggagggaggaggattgtaaagggtaggtattgaatttcacgcctcagcaaaagtgtggcagtagaatttcaaggaaaggcgggtaaaataagtaagtgtaggtaagagaaagctcaggctctcaaaagggagggatggtcggtcggaggagaaggaagagggaagagagaatagtaagagaggagagacttgagcaggtgacgttgatggaacgacgaagcccgaacacgcgagggctgcaggaacgcgggaataaagcaccgggaggagaggaagaaggcaaggaacacacgagccaactccgggcaaataagagatatcagtaagaatagtaatggacgtagttgaccagggaggacagtagaaaaataaaaaagggtaaagggggggaaatagagagggactttcgaaaagtaataatgctaataatgaaatcgatgaatcaggagcacacgggcgcttttctgactctttggaagaaaccaataccaaaaggagggagaagattactagcacccgatcgaaaaccggcctgtctcaatatgtggttaagttgttactgttctctccctgtctgttactagtccgttaggccccagaaggcaacgtttgggtttggcttgggggaggaggaggaggggggagggggcgggagtggttcaacttacagcagcagtagcagtaactttacctttcccggatgaaagcctgggtaacaaccgatgagcacggagctatggcagagtgtggagaggcaacagagatgtggatgatggcggttggaattattggtacagagaacctgagggattgctgtttatggccgccggcataagaataaccattctctacacagtagcgttcgtcctcgagaaaagatcgttattcccgttcgaataataaaaagccccccagttggactaattataaggagaccacttatacctatagcccaccagcctagttaagagtaccccatataaagctatgggtatcttagcactttactccatttcctttttcttttattttaatttgaactgattctaatattaattatcttatttttattatcccatctcattacggcaactggtagctaatgatgaaactccataggcatgagggtatattgtgggctcggccccggaggggcaagaaaattaaatagctagaatgaaagaaaatggaaaagggaaaagagagagagagaaaagagagagcgcggcgtagtgattggaaataaagagtcagtatacgtatgtactgataccatacaataccggatcggccgctctctctgccccaggtctctgcgtcttgctatgacgctattgcccttaccggaagcaaggtacctgggtaccgctagtagataggcggcggtgctacttctgcccatctcagacgatgccgctaagatatgtcactatatacacggttgatgagggttttctacatatgatactccgtaattactttttatatcctagcttctgtacagaaaaactgttttgcaccgctcctcaccaaccaacaccccctcctgtcaatcgggataggaaaaaaacatcgattggtatctgtcccgcatcaagaaagaaaaaggagacatttttgggtccgcggctggcgtcattcctagaccgaatatgaaacggaacggtaggctcagaagtgtagataaaacataaataccatcaatcaggttacatctgaaggtagagttgtaacttgagcagatcagtaggtcgaaaataatgatgacggactttaaggtggaaccatccagattgggcgtaaggtagacagctgctgctgggattgagagaatgagggcccattcctaatgggcatatgaccttggctccgaacgcctgggttcgagatttaacattgatattgtcgtccagtaattatctagctagtggtgcttaaaatgggggggcgtgatgcatctccattcccagacacccttggatcgcagtagtaatgtttcccgttagttatgttgggtagttaactcctccaccaatgcaagcagaccacgctcgggatcaatggccttgattcctaccattcctggcatcgcatttacagggggtgggctagaacaagaccagcaaaaccaatttcttccttgtccctgcagtagagaaaggaggggttggtcaggagatctccgtaactaactaactagcaaccacggcggtacttctgagtttgtacgtaagtgatggaagagaaaccaacgctcttctagtgttcggtgactcgcgcgcctcaacaatcttccccccctctcctgggaaggagaataacccatatcgaccttaggggcgtatctagtgtatcttcagacatctccgctgagctcaatagctagttataactagctctagactttggagggatccaggcctttcaacccatctcataacttcttcccgcggcccgtcgaatgccgatcgggaaagccaaaggcgagccacagaaaaggtgcctggatcactagtacctcccaaccatgtcatagcccgatgaagatttcaagacatggacagtaagaggtaagtagtaagaaggtcgggaggtggaaggtccactgggcggttccggtgacaggcagggtagttctgccatcatgtgctgccattggcccctgggtgtcaagtgaccagccgcgattttcactggaaacccgttcattggctagccgtactattgcatacgtatggtaaatacagatcaagccacccaacccaagaaaaatgaacggaaaccttgggttaagtactccgtactaactaagtgctgaggcaaaatagtgcggagggaggcgtgtgtattcggtcgccgcatatctgaccaggatctagacttcaacgtatttcgggctgcccaccaggaccggctgcatatgtactctgactctttactcttactgaagttggattggaggtcggcttggaatcccgtcgggaagactggccataagaaaatatttcaccatgcgactgttatatccgacgccacaggtacagcaataaaggatgcttgggtcctatgccaatactgcaatgacgtagcaataatcaccatctcaatgcgggatcataagggcatcttctctgaccaggttcgaaaataggcgagcgcataacgcatgtgtagtgttcagagtcttggtttatcagagtagaaaaagtaaaagtatactgcaaaaacgatctggatgcattgggcgatgccttgcccacgtgcatattcgtggcccaagctcatcgtgtccacgcttgagttgaccaaccaatacttgtagccgttgagcattagtagtcatagtatatctactacatcgttgagattcgtacttcctgcaacccctcaacaaaaacgaagtactccgtcgagaagtacttcaatgtgtctgttcgtaccgcatgatgcaattgcgccccctctgcattcatccgaacggtctcttgtaagctcagctttgcatgggcatgttgcttagcggcaataaactctcgtcgggttacaaatctgtcgtattggaagcggatgacatatcacaaatttacatcatccactcaagctcagaaacagaagagtcacgggatgagaacagagagacgacgtatctactatctacagccaaccccacaatgactagggtaagcgcatatcgtactaattattatctagtactaggagcagctaatgttaggcttcttaatatagtagcaagggtcgttgtagtcctgatagtaaaggcgatcatgtgaagctcatgtttcacacgtttagctgtcaccggtagctcaaagagacaaatcctccgccttttggagatttgcttatccctattcacccttttccatctttctctgttctatgcctcttcattagacttggcatgcatgcacctcgatcgtgtacgaccgtccgacgtacatgaattttcattcatcggctcaacataacagaaatactctgtgccgtttcctagctcccttacctcccctatccttgcagattgcttcttcagaaacatggaattaagtaggttgcttataagactcacggaggcatgtcacgattggacacgattggacatctcttgcatttgtcttctgacttgtgccaatagtagcttagctgtcactgaaccttggggcgcaagaagaggaagaacacctacggagaaaaccggcacggagattatgcaaatcccttgctgcgcggacctgcgagcatatcagctactacagacagtaagtctcagcagaccatgatcccagataataccatttgaaaaggctctgcttaagaattgagaccatgccattgttgaaccataatctccttattcgccacctcatctacatcaagtattcagaccacatgagagattaattgcagccacataccaagctgagacagggaagggcttgagaaatctaatgctcggaaacgttggggcaagccactcggaactcatccaggcgtgtcgtcgaattaaagacgaggtcagagtgtatattgcatgttgaaaaagggtaaaaagaaaatgtcaatcataatgacattcagctcttgcgttcatgagctgtaagagaagaatggatgtagaagcaggagagtagagtactagtcgagctatcgtagctgtcctgcaaatcgaattcgaggccaggcacattcgctgggttcattcattcatcattcttcttctttttttcgttttctctacttatctagcttcaaacatacatgggtagtttatatgcgggctatagttccggtgacactgcagaccgtctatacatcccattgaagtttgctggtgtgtgtggatataagctgagcatgcacgtacttggggctaggtactcaatagtaacatacataccacatgtgaatttatctgctgatgctcgactccgggactcgaaatacaaatacaatacctggcattcacactaacaagtatcatattagaaatgccccacatcgactcaaatggtacctcaaaagggccaggctgattgatgcacataagaaatcctcctgtgtgcatttgtgcgcttggccaagcgcaccacggaaagtggcaggctgagagtctggaagggctatggctcgacaaaataatcgataattgtctataatgaggcctagttgaatccaccagctcaagagtggttacagtaaaggggtcaggtgattattgagaaaagatacgacaattgatctaccaaaccatgactttgtgaatctaggtgcaggcagtgttgttcatatgcttcggattaggctctactagatacgctctcgtcctgctactgtgcatacctttccgacataccatacccaccaacaaccagagacagccagcagcagcggaggagaggcaggcaataataccatggctaactgttcctacgaatcatgaaacatcattaatatgtagggctcttctttagggccattgcaatcatgaggtgggttacctcattcactgatccttggctctcgttttcagagtttggcccggtcggcaggcagcctaaaggcatgcatgctgcttggttactacggatcgccgggggggccacacagcgtcagcagatcacactcactggctcaaggtggtcgtgacttttttcttttttcttttttccgcccccctctctcccgagttcctctcaggtgaccgcagctttgttgtctcggtgaggcaactcatgcaacaaccattggccaccaaatgaacaattttaccactgcttcagacatccctccatagttcatgatgcgattttcgtgaaacagactagggaccctactggaacacaacttataccgagcctttgattagtagttccaactcaacgatggtttatttgataatggtgagtaggaagcagcatagtagaacggcagaccagtgaaatggatgacatcgatggcttagttcccatcatagttgttccggaaaggaatgctgcaaattctgctttatctactttctcgatcgtactatgtaggctgagggcccgtatgaccgcgacgttgaaacccccagctactaatgtagatgttggtagtaccatatcgctcacagcgttgatatatctgaatatttggtgtccaccactacgactaatacatccctaaatgctaccaaggcttgtttctcggaaaagacaaccctgtatcttgacaccatctcttcggcaggagggtcaaacaattgtgcctgccttaaccgagatcaacaatataaccagcgccgggcccccccccccccctcgtttgcttagtatcgtccagggcatgaacacagctctactgtgtaccaaaggacggatgtacctgatcttatcaaaagaagccaaaccctgccttggccatcttgtctataaaacctggcccgatggcaacaccacaattgttctctcgaatgtcaacactgctccgtatgttgtgtcatcttggctattgcccttcgcggtagactttggcatgaattcagccgcggaatcctgttccttgtgtcccgagatgcctttgtgtcagccagaccaagtatccaataagactgagggaggtctctctctctgtctgtttctttgagcgtgaaatttatttgggcgaccattgagggacaactacaagagcaggaaaagtggaaacagggtaacatggcccaattatcatcactgttattgaaatcaacaatgaagaccccccatgaaacccaccacacgagcaggtccagcactaaggacaaagagcgaaggtgatggacgggggaaagagagagcgagtgagagagataatttcatgtccaaccgaagagatagggaatgatgtcaccgtggggcaactgttggccttctttccgccaacaaagggtcatcgtgaacctccaaccatgggtttctcctcgctttcagacccaaggattgccacagcacgaggcccaaccagttggggggtggttttgtgaggcctgatgagcgaatcggacctaggtgggtagtaggaccatgtaaccgggttcggttccgtcattctatcctttttcgaatgtcgagctggccggaggtgaaggatagaagaccgtagtagatagagtggaggctaaaatagctgctacatcgggagtagggagtcttggagtctccagagtgaggagaaaccgggggaaaaagcgcagtagtgcaagatgtgccatcgggcgggattgaaattcatgggctaatgaccgggcacgacggctctacttccttttccgactctccgtgacgaatatatattgttcagattatcttgatatattccctgtagtactacctttagatggccttgggctcgccgaaaaaaaaaaaaaaaaaaaaaaaaaaaaaaaaaaaaaaaaaaaaagattgtgaggcgtttgaccctgtaggtcctacaatatactaaatattatggttttctatatgattctatacagtaaggagatgctcgcataaggtcgtgtaatattcagaagtatttctagacgttcaggatttactcggggcacaatgccatcaccaggcacaataactatctagttagttaaatcgctgtatgaatccaccaagagttgagtatccctcgaagtcacctgcccaacacagtttaacgatggagtaagagaaaatggagtcccctcactaactacggagtaaaggtggagattgctagcctgcgtgcctccaattcccaactaacccactagatcagaatcttgcctaattacagccagaccatgattgtagagaacccacctgattcccacttaatcgcgacactatcatcccagtttggcccctgctgctccgtaggaaaagggtaagaaggaatggtgggtttgggtcaaacagacgaccacgctatctttttagcgtccaagacggcgttttcgctgtgtcgggccagacagagttgaggggagtcgagttgtatatactattttcgggcaatgggctagaaaagtgaatggatccttgatccttgtatctacatagtattatctcaacgtggtagtctggttacattattgttcgttactcacccgctagtgttatagttaagttgactgacagtgtttatccatcatcttctttatttgcggctttgattgaccaccaactactagttagataatcaccgtgatcatggttctggactctttagtcctttgctgctcttcccttcctacctttcctgtcttactgctagatcaactcctttgtttcttttcgccgagaaagtatgttgatcgtctgatccgggatttacttcgtcgagccacagctagtggcaataactttcgtgtggcagtcgcaaggtgtcaggtggttagggatgatcagggcgtgcaaaggtcatgctcatggaaatatcctcgcgacagattcgtagcgcagaagtggccgcccttttggagacatgttcgagcggaatacgagtcttgccagcaaacaccttgggaactcttagttggcagtatgacatacgagaggagggaaggtgttcccgatgccgtgaaagttatgatatcctggtcttactccaatcgttgcaaaagatctttggctaatgcaggcgatcctgatgaatgacgcgggtccctcagcgacgcagggagtccatcccatcataaggtccgtcactctcacttcgattttccatatcaagaagcagaacgtgttttacattgccccatctatgatgcgttaaggataaaaaaaaacaaacaccgcaacagttttccgcagatgatgcttccatgcatgcctagcagtcatgtccatcggccaaaggttgccgtcgagataagagacgaaaagaaaagtagaacaacaggggagggaaaacaagacagggatacattcatagatgaaggcacagacaaaatcgaaatgatatctcgactggaccgaagatggatctatacaaaacttggttccgtggcgccaaacgactgcctccctggaccagcaaaccgcattcgtgggggataaccgatgtgatacaccatcgtccaaacatgcacatggagagagaagagctactaaaacaaatagtgaaaaaggtataagccgagggcggatgcagagcaatagcttctgtcctcccactttcaggtgggccccattagccccagctgcacgtcagagtgtgcttagaagggaggagggaccatgtcctcagggctcatcttctcttgctgctccatcagttcctcgcccgcgatctcaagggaaacagcaagaccgagcttggccgtttgctagagagaaaaaaaagattagttattaatctaccatttggaattaaagagcattgcaggaagtgaagctcaccttggcctgatcgatctcaccggcaaaagtaagagcgatgggcatagctatccgcttctccaggaggcagctaacctttccggtgctgtcgacctgagcacggaaagtggaagcacggaagtcgtacttggcaccaatggcagtagtgccgtcacggctgggaccacccatgagagcagcagcggcattaggcgcgaactggaggttcatgtcaacaccagcctcaacacgctcggagagcttcttccagtaggaggcggtgatgacaccctgagcctgcagctgagcactggcaatccagtcggcggtcttgtagcgggcaccgtaggagagagcagattcaggacgagagttcatggcctggcgctgccagatagcctcaaagccaagagccaggttgggagtaacagactgaaggtagcttccgacgaagattccggtaagaccaccctccaagtaagaagggttgaaagccttgagagacgcggagaagtcgtcgccagtgtagtcattatcaagctgcatcaagccctggccaccgggcatgatctgagtattggtcttggtgacgaacttgggagtccaacggtagttgccgacagcagcgagacctccatcgcttccgaggttgccttgcatgaagacctagagttccaacgagagttttttagtcacccacacataatatatatctagaggtaagatataacaattgcaccttacctttggacttccgtacatggcggagaagttgtatgggggcatgttgccggatccgcccatggagaaagcgtgcgacacacggaagagaggagacatgccgaaaaccttggtcaggtccgcccggagaccggtgaacatgaagttggacagcaggacatccttctgcacctcccgggagatgttgtccaaggtgccagggttgggaaggccgagggcggccctgcgctcggagaacgaggtgtatgcatccttgaaggccgcggccacggaattgtccgtgaggaaggaaggcaaggctagagagtcggacattatgaagtctgaggagatattaaaggtcgttatacaggatagaagaaaaatggagggtgatcgttatacgcggttcgaccttgttgggggaggagagaggaaaagagaagagacctcgttgagaccagcccggaaattgaacctggaaaggcgaagagcaacgtgagggataacacgacgctcttgctaattgacgggtaagggttgtgtccgacctgctctggggggttgagaggagggaggttgaacaccagggcagatggattgagggagtgagatggatgagatggtgatggggaagttcagtttccaggcgttctttcgacagccagagctttcggctttgaaaaaagtgactggcgcctttccgccccggctgcgctggactgtcgctgtgctgcgccgtagttccctcaatttagtctagcccgcttcgggctgcgccgggattgggatctttagtttggccggcgatgatataatcctctaagttatctagttcacttgctaactaactgactagttcatctctctcaattgatgaagaaggggagaaagacaagaagatatcccatgactcccagcatcttctttttttttggtgaattgttgtactcaatttgtcttgactcacaaacccttcccatctctgtttctctctctttcctcggggacaagcaaccaatcgggtgtagatcggtctatagtttataccaccgacggtgtacagctctactactactcttaccaactactatcagttagttactgacagttacatcaactgatttgactttgctgccgcccgattgggctgccttattttattttacctgagtgtctccttacaaaagctacttataactactacctaatcttccgttgttactgggacttgcttttgtgcggggatgtactgagtgccttccttacgtctctatcgctctcctaccgatacccctcgtcagcccagccgaagcttgactctaatcttccttctccccgaagtatcccatcccatttcatcccgccattattatcactgcagccatggataccctactgtaagctcgactcagtccatctttcctcaatatgtttcacttcttctctggatcgtcgtatcgggaacggagaacttgcgatactgccgaatcgttcccgattatcgatctcacttgctctaacgtactcctagaaccgcggacatcgttgccaactccccgcgattccggcgcaagtcgtccactttcgtcgatgcaattcacgatctgcctgaaaaggccgatttggctcctgcgcagctctacagcaccgaatccggccgactcttccactccggccgcattgtcatcatcacggtaggattgccggcaagaggcaagacgttcgtttgaccaatcccattcgtcattggcccactccattaatcaacctttgctcagacacatgtcagtcgctctggcacgttaccttcgctggtaagcgcactactcggctcatggctctatcgctagcagaatcgaactgacatcatcgcaggttgggtgtcaagacaagaatattccacctgggcgattatcgacgtgctaccatcccttacggccaagatattcctgacgactacttctttgtcaacggtacgcgatgacctctatatatccatgcagacatacttaggcccgcctgagtggctgattgaccaccttgcttggacgacctcgcttgctaacgggacatatagcatcggcttcatctgtgctcttaaggcaaaagatcgttaagcgatgtcgcgaagatatataccactttttgaatcacgagaacgggcagatagcgatatacgatgcggtcaatcccatcgcttccggtcgacggtcactcgccaaggaattttccaagcacgatatagaggtactcgaaatcaccttacccgtagagtcacacatctgctaatcctgccctctatggcaccagactctgttcattgaatcgtggtgtgacgatgaacgcataatcgaggagaatgttcgaagggtcaagatatcctcacccgacgtacgtgtagctacaatggatccccgagtctgtcgcgcatactcacccttggcagtacgtagggtggtcttcggaagatgcggtcaaacattatttgaccaggatagctgcccgtatcccccaattccagaccatggaagagacggacctcaattacatcaaggtatctgctgtattctgcatgacggggcttctttcgctaactcctcaccagatgatcaacgcaggtgaacgtttgattgtaaacaacaaaagctttggttatctctctaatcggattgtgttctacctcttgaatctccatatcaaatcaagacacacatatttcgccagagtgagtctgcccgttgcgacgcatattggcaggggagtacttaaatgactgacggaaatttgtgcgaccaggctggtgtttcactggaagcaggctcatacaaagcagatgcctcactgtctgagcaaggggaagaatacgccaaaaagatgacagaatgcttgctgcagcacagggaggctgaaagacaggctatggccgaccaaggggaaaaagactatgaactgaagccgctgacagtctggacatctacacgacggaggacagttgaaaccgccaagtatcttcatgagaaaggatacaaagtacggcaacgatcacaaatgagccagttaaaccccggcgtatgcgagatgatgtcggaacggaagatccgtcaggagtatccggacgaggtggcgaagcatgatcttgacccctatcaccatcgttaccctcgagcagaggtaggtcgtgtcgttgttttcgtttagccatgggaatctcggaactgactggaatggtagtcctaccatgaccttgcggtgcggctggagccgattattctggagcttgagcgcgagcagaatgatctcttgatcattgcgcacgagagtgtactaagagttctttatggatacctgatggcatgcaatgcagccgacattccattcctggaattcccgcgggacgaaataattgaagtgaggcgattttacaggtctaatggcgttgaacaccccagctaactgacttacttcagataatacccgaaagctatcagaacgaggcgcgtcgaatccacatccctggtctacccaaagagatcatccctggctcacccgaagacatcaagattcccgtcccaccgagtgggatgatgaccccgctggctgggggacttggaagcccaaaggaaggcctcgcaacgccgcagagtggccttcgaactcctcgggagcccgagaggatctcacagcagcatgtggaagatgttgtctagaatcgcattccatcttgtatatagaaccccgcgaccgcttgcccgtaggagtatcatcggtacgattgtgaacgtagacagtcattagcgctagcccccatgaagcgtagaaacgaagacaatgttatcattttgttgaagttcgtagttctcctcgccttcgagctcccaatcggcgtcgttgatgagaaccaagattcccggtcgactgttcgcccaacgtcagtgttcttgccttgccgtgtattcccatacggtgaacgtacacattgccttccagtatgaacaattcctgcctctgatccttcatgtagttcttcaccagatgacccaggaggtagctgatagttggccggctgccgtcgtcaagaagcgaaggtagcgtgacgtggtgtttgcgctcattggcaaacaagatctccagacctcccctgtttgcgaaagccgaatcagtaatgagtgcaaacctggggtgcttgcatgatatgggtgagagccgaacgtgaactcaacggtgatagcaatggagccggagccatctttgcccagatcaggggctccagaattcgtggccatgcttatctatcgaaggaaatgtgtacagccgatgtcctagtcaatatttaagtgaattggggtagccgtgggatcgtgaaggctcgtggacaagacctagaaattgcgacgaggatggagatggaggggttggcagacgacggggtccggatttctcgctgcttatcgataagccgcccagtttgccggcacaaaaagtcggctggctgtgcgatccatctgaacatggttggttggtgacgaacaaccacgcccctcgctcctacttctttgtcggtctgtggctctatcagcctgcttgatttccttcggaaacacctggacttaattgctcgaacttccgacctggacgagcttcatggtctccatcacgaccgagtacatcagcgtcgggggcaataggcatcccgccgccgctgactgggacgtccagtcaggcgtgcttgcctttggcgcagataacaatgttgctctctgggatccccgagtaagttactcctcaaatatttgcttggttactttcaagatggtggtggttgatgctgatggtggggccttgggtgatgatgtaggagagctcgcagcgcggggtctattcgcttcttgtcggccacaccgacaaggtcagtgtcgttcggttctacacatgcccttccaccggcacgaaacttctcttgactggttctgttgatcatacggtccggttatggcgccccgatccagtaaatccccgccagttcgttcacgcgcatactttggaaggacataccggctcagtcaatactatcgccgtagctgaaggattagacattatcgcatcgggcgcagctgatgctagtgtgaagatatggaagatcagcgcgcagggagagccaaagggcgaactcttggaatccattcccatgaagccacgcttctttccgttggctttggcattgaccccgctccaaacggagtcgaacgatagacctgtggctttcgcggtggcagggaccaccaacattgtgcagatatatgcagcagagaacactcttgtcgaccccgatttcaagcttgcggctgtgctgtccggacacgaggcgtgggtgcgctccttgtctttcacatcggataagcaaagcaagatgggcgatttgctgttggcctcggcaagccaagacaagtatgttcgactctggcgattccaacgtggagaggttacgcaggccacgccggcgtgtgatgatgatcctatgctgggtggcttcgagcccacgctatcgaataaggcgcaccagttcaccgcggcggggaccaaatactctgttacattcgaagctctcttgttcggaaatgaggattggatttacacgactgcgtggaaccctgacccggagcgccagcaactcctcactgcatcggcagacaacacattgaccatttgggaacaagatccggtttcgggagtgtggctttctgccgaaagaatgggagagatcagtgttcagaaaggttccactacagctactggtagtactggtgggttctggattggtctttgggccccagacggcaagcaagtcgtgagtctgggccgcactggaagctggcgctcgtggaagtatgatgcggaaaccgatatgtgggcgcaatccttgggtatctcagggcatgtgcgggcatccaacggggtccaatgggagcctactggaggatatctcctgtcgacaagtgcggatcaaacgacacgtctgcatgctcagtggctgcgtgatggactgaagtcatggcatgaattttcacgacctcagattcatggatacgatttgaattgcgtggataccctgggcccggctcggttcgtgtccggcgcggaagaaaagctactgcgagtatttaacgagcctgcgcctatcgcacagctcctagagaagctttcggggttcaagcagacgaccgaaggggcattaccggacacggcacagattcccgtcctaggactgtctaaccaggccccggccgatgatgcgcctacaggtgaagatggagtagagggcgaggaagttggcaaagctcaggccaatcaggcgcttttggcggaatcggagcaaccgccattggaagaccagctcgctcgctacacattatggccagagcatgagaagctgtatggtcacgggtacgagatctcagccgtggctgtcagccacgaccgcacacttattgccaccgcttgcaaggcgagctcgattgatcatgccgtggtgcgtctgtacgacacgtcagactggcacgagattcgtccatctcttgccgcgcacaccttgaccattactagtctcgccttctccagtgacgaccagtaccttctgagtgtcggacgtgaccggcaatgggctgtttacgaacgcagcgaacaggacccctctactttctcccttctaatttcgaacccgaagggtcattcccgaatgatcctcgatgccgcatgggcacctgcgtcgggaaagcccatcttcgcaaccgccggccgggacaagtcagtgaagctgtggcagaagaccgaaggctcctttgagtgcaaatccaccatcccgctgacaacgcctgtcactgcactggcgttccttccgcagatatatagcaactccttcttcgtggccacgggcgaggaaagcggagcagtgtctgtctaccgagtcgcagtcgacagcctggaagccagccaattgtcaagcatcgataagcttgcatctccttcgaaggcgatcacgcagctgtcctggcggccggtaccggatgtagatacacgggattttgcactggcggtagcaagtgaggacacttcaattcggatatatagtttctcggacatggtctcataaccaaaaaggccgtatatgtacagaaccaaaaactaaatgggcagaaaaccgaagttataataccatgggttgaaatcgtgcacaaatgttgaaagcccggactccttaaatgttgaatatatcccttccgggtcctggaatccttctagaaacacaaatagttgaatgatgctccgaacccctgctatgcatatccagtatagtggttgttgaaccaatcatgttgaacgatgccaaagaaagaacttaataagagcagatgaaacaggtgaaaaagcggatgggattgaggagaggcgcactcgcatgtcatcacgcagcaggccgcttttccaagccatacccgcccaaaccctccagcgacgggtaagtcttagcctgactggtgaacccatttctcggacccctagaatgcaagtcctctttgagccaattcagcacaagctcaccgagctgactattttcggaggtctccttaacctcttcgcggaacttctcaatgggaccccactgacgcacgcttcccaaatgcatatggactagatgcgtaggccacagcgacaagttatccaagatatgggtcgcatagacgatagtacagggtctggtctcagtctcacgcttaagaaaggccaggaaattggagcgagagaggaggtccaaatcgacagtgatttcatccagaaggaggacttgccagggccggaggaggcccatagctagctggacgcggcgacgttcgccgtccgaaacggcatgcatgcgccagcggagatcgatgtctaggatgtcgacgagttcatcccggcggtcagggtatgcgttgccgccgacggaggcgaggagggtagggacgtcgatgtcggtgcggacgatgttgttgagaacccattccatgccgaggtaggttacgccttccaggccgtccttgaaggggtctttgcctgctacggtgatggtgtctgtaggagctagacgtttgcctgctaggaggcggaggagggtggtcttgcctgcgccattggctgttgagggtggtttagaagttagtttggttaatacgtgctgaggcaatgagttggacatacctccaataagtagggttcgactgccggcgggggcttggagattgacgtcggtcaagccgggagaaccgtcggggaacttgaaggataggttcttgacctcaattgagggggaaggggcgttgttgtctgtcatgatgagagatgcgaagagcgcaaacaaagatgaggggaaagtcaagtgatagaagaatagcagaatgctcttatctatctagtagtgtgagttactccagtcgacgtcgttgtatctaattaatagcaaccgatttaaacgaagatctataatcaaaaaggcatagaaacgaagactgcaaattcgtcaagactcaacgagagaagaaaaagaaaggaagaagaggaaatggaagagaagcgataagacccgatgaggtaataatggatcgcgatggcgggggaatttgcgccgggaatttttccagagccgcaccgccaggattacctcccttcgagcccatcagctcgcggtcttcttcgccagatggtattgtcgaggcaaagatgctaattaggtcctgtttcaaccctccatgcgaccatttctccgacgctttacgtctctcaaacgcccctccgtcatgaagccgctcatcgctgtcgttggtgccacaggcacgggcaagtcaaaggtgagagcgtttacccagcccgggatcctggaatttccttccttttgtaagagactgcttactgacggttgcagttagcttgcagtcgacctagcctcgcgatttaacggggagatcatcaatggcgatgccatgcaaatgtatcgcggtctccctatcatcaccaaccagatccccgtcgaggagcgaaacggtatcccgcatcacttgatcagctgcgttgagctcgaggaacagccgtggtttgtcggcagattcagaagcgaaagtctccgactcattgacgacattcacgccagagggaaaactcccgtcttggtcggtggtacccattactatacacaggccgtcttgtttaaagaccagctacttggcgaggatgctactgcagacgatgtgcaggaggaagccgtaaatcaattaacggaagataacgacccgaaatcctcgactaaatggcccatcctcgacgctcccactgaggtggttctacaaaaactgagagaggtcgatcccgtcatggcggatcgatggcacccgaacgaagcacgcaaaatccgtcgctccctagagatatatttccagaccggcaggcccgcgtcggaaatttacgcggagcaacagcggacaaagcaggcggccctgattcgggatgactcccttacaggtgccggtcacttgcgattcccgacgatgatattctgggtgcactcggagaaggagacgctgaacagtcgactggacaagcgggttgatgcaatgctagagcaagggttgatgacagaagccaggcagatgtcggattaccttcaggaaaagaaagctcagggcgtctccgttgaccagagccgcggcgtatgggtgtctatcggatacaaggagctagcaccctatttcgaagcactatatgccggctcggcggatgaggccgagctagagaccctcaagaaatccggcattgagtcgatcaagactgcaacgcggcagtatgccatgtctcaaatcaaatggatcagaaacaagttatggcaggcccttgcagatgcgagttcgaccaatcgtctctacctccttgacagcactaatgtcgacgcatgggagcagaatattactgagccgtccgaacgtcttgtccgtgctctgctggaggatcaacccactcccgatccgaagtcactgtcagaactcgcaaggacggtcttgggcgccaaggaggcgcagccacataaggagtcgggatccgtcaccaagtgcaggacttgtgacatctgccacaagaccatgatgggcgatgagcaatggcatatacacatcaacggctcggtccataggagagctctcaagagcgccgccaaacgggctgcgcgtgacgaatatctacgaaagcgacaaaagctgctacacgagggtgaggagaagggctctgaatctcccgcggagccagatgtacaagcccctccgtcctcttaaaccagatagacagacaaatagaagtctcaaattaattgtcaatagcaccgaggtgccttgcgtctcaatgtaaatgcatctgtgagacccgtgggtaaccatgtacagagattcttccgcgcagtgcatgctagtagaccatctgcatgtttgctttcacaccgtacatgtatgcagaaagcaggtgcggtcaagaagacaacaagacaacgctgaccgacagccagatgacatcatctgaagaagcccctaacttctggctgtgtttggcatagggcttggtgtttggggcagcgaatagatgtcagacataaagcattcatttgcaatgattgcacagcacatacttgtcacagcaccgtctaggtccagtgaccaagtcgatccagccgatgccgcaagcgagttcccatgcatcaagccaagaggcaagcatatccctatctgttgatagcagccttatcattcttgcgcaactgggtggacaccgagcttctctttcactggaggagtagcccacagacgcagaatcattggaaataaagaagtcaatgactgagcgtttgtatggctcaagatttggacctccaggccgaaaatgctggtgagataatatcgccagttccactctcctccaccctgaagacttcaataagcgacgatttctcccgtttgcgtattctccatgtgccttcctcttgaatggtagttttaagccctgtatcagtcagtttagatcctgcttctttcttttaattcgggcgaaaagattgattgtatacgcacattcaaggaacgtggcagcgaagttaatgcagatatttccgtcccaagtcgaccggccaagcttcttgacttttccgggtatggcagcagtctcgagctcctcaagacgatgaacaataccatgttggtcccgaaagccgacaacgatcttgggtaccccgagtaagaatgactgggcccagaatttcaggagcttcctttcgtatttcaccatgtcccggtcatttctaatctcggcggaggttttcagttctacccaatggatgggatcttccttgcgctcaggtttgcaatcccagactgtgaacaggatgcgttagaacatgatatatgcgctgtggcacgtggttgtgacggagtggtgggtggccttttgacatactcgcatctacctccccaccaatgactaggcgtgcgcggccgattgcagtgcgcaccactgaacaatactgggcattgttgttcacaatgagttcctctcggttttcaatctctctgcgtggagtcggatcccacggttcattaagcaccgacagagtctcaaatttataccctgactcggtcaatgacgtttctaaccgtaagggaaagagagctcttaccccagtaggccatcagatcctgggatgccattcccggaggcattcgttgatttttctgaattcgtttctgctcattcttgtagctgttgttctcttcgataaatctggacggtaattagagtcaggagccagtagatatagcaggctagcataaaccaacattgttccctggaagcacattagcaaagagtccctaaatcgatggctaattgacatacctggaagcaggtagcgttcatttcgaagctgtacgcaaatcaatagctgaagcagaagaacgacaaatcgagaatacacacccatttaagttatcaaaaggagctgcaaggatctagacaaatccaacataagcatatcttttgatcccatacgactgaacacattataggcggggtctaccttggtcatcatgcctctccaggtgataatatcagcttcacatttcttctgcgtttcttgttccagggctatgactgtctcgagcagagcatctagatgctcatcggctgaatcatccagcttttgaaatgactcgaatccgcggttcaggtccgcgggaaggcatggcggatagtagtatttcatcgatgaatctccgagatggaacttatgctcatcatcataagagaaacatgcaatctcctggacaagggttaagggttgactttgagcattcggaatgaattatactaagcttacctttggacgtcgaatggcagcgctagctccgtagaagcggccaatgggctgaatatcaaaggccttgcgatccattattttgagagattgcccggatatgatggtgactggatgcgaatgcgcggaaaggttactctatgtactctttctgccgtgcgcgcgcgcctttcacgagattataccagggattcagaccatatgaactaaagtctcaaaggcgtcctgctgttgcttgggaaggaaagaatcagtggtaagagtgaaaccattcacctccaatatagctaggtatgaaccctgcagcgcgcaaatgcggagaggaagaaataagtagatcgtcgttgcagtagttcagtccagctgctcccgtcattctggaagaaccgaagcgcgtccccaccaaaagtcgcccggcatcaactttcccagccgcagtggcttgacgtcgtcaaccatccccgattcaggcctgtcgaacttgttgcggtcgctttatttcgctttcgccctcttatactattttgtgggctgtctcgttataccaatccatcgtgttcactgtatccccgacctcttgacagtcgcccctggtgattcatccgttctgaagatgacctcacgtatcgacaagacaattgctcgacaacgagagaagtgagccaacaccaccttgctgcttgtgccgagcagctctctgatgtctacaatgatttcccaaaagaaaacgataactgacgcatcttgtcttcttgaaggatcgcttctggtgcttactatgaagctcaccagcaactgcgggtcatcgctgcccggtatattaagcaagcgaactacgatgcggcggcagagcttcttgccggcggggccaccgctctactgaaagctggatctcagcagggtgcttctgccagtggcggcgatttggctatcatgttggtggttgaggtctacacaaaggcggggtgggagattactggaggaaatgacgatgcagaggggcgggctcggaagagtgagtgcttgcctatgccatcttatatattgccgcgcccgcttgcggatgtcatacggtgctttctagaactgatcgggctgaccgagggctccctctatctacagagcgcttaatcgagcttctgcacgaatttccccccgaagagcctacccggagaaggtttatccaggagattatcggctggagtggcaggtttggacccttagaacgcggcgaccctgagttgcatcatgccgctggatcggtatacgcggaaggtatgcagacccataatgattctgatttcgagggcgacttcataacagttgtctctagaccacgaaccctatgacgcggaaaagcatctcatcttcggtacctcggaatcagctgagactctggccaaacttgagttcgagtggtacacccatgacgaaccgcacactgccgcaatctacgcctctcgcgcggtattcccctatctcttgatcggaaaccttcgcagcgccaacaaagcgttccttattttcacgtcaaagctttcctccacaaacccctcactcggcgtgcaagatgtcagtagcgctagctctgacgtacgcgtcttccccgcgctgcccttgctgaacttcatcagcatgctgctccttaccattcagcgcggtagttcggatttgtttaaacagttgacggcgcattatgcatcccatatcaaagacgtcggaatttgggatgacgcactgtctcagataggcgagcaatatttcgcaatcaaggtcccaagacagagcaacccgctactggatatgatgggaagcatgttgtttggtggcggtcaggatggtgctggtgctggtgctcggatggcacctcagggcagaggaggatcgaagagggtggaagcgcctccgacgagtatggagctcgattagaggaatttctggggaatttgaccatgtagaagaacgcagtctgaacgcatcatccatcatgcatcgtaattagtatagaccatatcgcaaacgaatctcttaggccctcgagtcgacttcagcctcgtacatccagttatcttcctccagggcggcgaccttattgcgaaggctctggtgtatacgattaagaatttctatagacatcagccgaatcgcatcgcgacataaatcttcgagtgtagttgaggcttaccggctggctcgatactcatttgtctgtttcgatttcgatacatcatctcaactaggtttgcctccatctctaattcctcattagttcgcctgactcgggcgctcggggccagagtctcgacttactttccttctcctgcgcagttaaattgtcccctgctgcaccagcaccatccccggcacccacactttctataccctccatttcctcaccatcttcaccaaccaagggggggagtacagggacatcaagcttgtagctgccgttcttgtccttaaccacgatttccccgttgtcgatagatccggagctcaaagatgtagatgcatcagacgacgcggactgcagcagttgtgacgatagaccagagggtccgttgctacttttgccctgtgcagaggaacctgcggggccagttgagccagcgcgtttgctaatgtggtggtggaagagattgcggcggacagaggttgttcccattgcgagggcgtgaggctagacaggtataggaataacgggtctaattaagcaataagtatagagtgtaagaatgacttgaagccggttagcaatgctttttgagcgacaaggcccaggtaaaactggtgtgggtagtcgtgaggtcggtgttgtagcaactgaagggactgggtaaatgaattagaaaagaattggcagagaaaaactgttcgacgtaaaagggtggatgagcataataattgctggtctggaactacatccaacggctatgaagcgtgaatacagagaaccctggattagcattgaggtgaagttgtaaggcgggattccgaaagcatcaccaaaacccagctgtcaactggctgcctctgagatcgcatgtgtgctgagcaaactaaagccggtttttctagacctggctcattaatagtacaaatggttattgtttccattatcctttcgtaataatgcatttctttggaatcgtgcaggaggcccgtcgattttggctccatcaccggcgaacaataactacccttttgggccaaatctatgccgacgcgtctccgcctcgactttcgcgtctcccgcttcttcagttccaacccatcaccagcgctttgttcttactctcggtctagcacacaacagaaccattcagcctgagctaacatataatttgcatcaagttatcattcgctatggttcaagccgaatcctcagccagtgcctctcgtaatggcctcaaggcgcatacggccggcgcccctcctgactatgaactgccctggtacgtacagcaggtcccagcactaaagccagcttaggatgtcgagtctgattgccaaatttaaacaatagggtagagaaatatcgcccggtatatctcgatgatattgttggaaacacagaaacagttgagcgcttgaagatcatcgctaaggatggaaacatgccgcacgttatcatctcgggcatgcccggtattggaaagactacttcgatcttgtgcttggcgagacagctactgggagacgcatataaggaggcggttctggagctcaatgctagtgatgaaagaggtacatctaccccacttggagagggagacgagagacggctttaatctaatatgctccaggtatcgacgtggtacggaaccggatcaaaggctttgcgcagaagaaggtcactttgccgcctggtcgtcataagcttgtcatccttgatgaggcagataggtacgtactagacagtgagctacattacctttcctggatgctcacggtggtatagtatgacatcaggtgcccagcaagctttgcggcgtacaatggagatttactcgtcgactacacggttcgcgttcgcctgtaatcagtcaaataaaatcatcgagccgattcagtcgcgatgcgctatcctacgttatgctcggttgaccgatgcgcaaattgtcaagcgtctgaaacaagtatgcgatgctgagaaagtggaacataacgaagagggcattgccgccctggtattcagtgctgagggagatatgcgtcaggctatcaacaacttgcagagtacatggtcgggtttcggtttcgtcagtggggacaacgtcttcagggtggtcgacagcccgcacccgatcaaggtccaggcaatgatcaaggcctgctgggaaggcaaggttgatgcggcgttggagacactgaatgaattgtggtatgtacacagtgcagtctgccaattttatgtttgtggactcgtcctgaccgtatttctagggaattggggtattcctcccatgatatcatcagtaccatgttccgtgtcaccaagacaattcccactctgtcagaacattcgaagttggaattcatccgggagattggttttacgcacatgcgcattctagacggcgtgcagtcactgctgcagcttagcggctgcgttgcgaagctttgcaggatcaacatgaagccgcagctctttgagccgccgaagaattgagatgaaaaacgaaagtgtaagttagatgcaggcataacttggagttttggggcgtttataaagcaaggctataccaagccctggggtatttagcatatgatttcaacactttctttgattttcaagttattgttgttagagactccaggtatcgtttataagattcagttcatacattgtaaagcatgcatgctggagactacgcaactcgaggccagctcgacagtctagtctcacttccttgctggcatgggagcagaaggcattctagcgccctccggcggcttgttcttgctcttgaagtcatcgcacatctgctcaaaagtgacccattccacgccctcgtgcttgtttatgtattcaatgattctagagcctatcagcaagccctccacacaaaacagttctaaccagacaagcacccaacttacctctcatgcataagaaggacatgcggacggcccgacacatcaggatgaatagtcatagggaagacaaactcatcgtactcgcgatagaagtagtcgaaatgatcctgtcagatcatcagttacatcaaaggccccaagaaccaacgcgtcaacctccaagacgaactcaccttccaaagatcctcaacatccttaggattcacccagccatgactattcggcgcggacttgataaacatcataggcggcaaatcatcaatataccagttgccggggatctccacgagccccgtatcctggcccctaaccagcggcttcatccaagtctccgccttctgggaataatcaattttagtccatgtatcgcccgtcctcaaccaatacatctgacaatcatgatgagacatggaatgatcatattcaattccataggagagcaacaaatcggccatctccttactggtttcccaccatggcgcaacgataccccgcggcggcttgcccgtgaaatcgtacagcatgtgataggtcttatcgagaatgtcccgttgctgctcaagggtcatgtcggaggggttttcgtgcgtgtagccatgcaggccgatttcgtggccggcgtctcgtaccatggcgcattcttcgggaaaggtctcgagtgagtggcctgggatgaagaaggtggctttgatgttgtatttggagaagagtttgagaaggcgtgtggtgccgatgtggccggcccagagtcctggaggatgtgagtgagtgtactactactaataagtaatactactgctgctacccgttggtatggacagggcgaagtatatagaaagaaagtgtgtttgttctgttcggtgtttggacttttagtacttacctcgactaatatcgttggaactgtcctcgccgccgtaggatcctagccagccggcgacagcgtcaatgtcgacgccgtaactgacgagaacgcgcttcttgcccatgttgatgtttatttgtgttgggggaaatggggtttgatctgggacaatgtggcagggttctttgtcggatatgtaaataggttgaatgagacgtgggcagtacaagtctacaggtttaaccgaggagtaactcttttccccccaaccttggtcattgatttttcttttatatagtcgatcagtgaggggggggccgatgaggggggaacctcgataattcggtcatctgagataaatgatcggaggggaggagataaggcgcgataaccgacatggagagagccggtgctacagcaatggagaaccttatcagtatgcatatgctactcgactcgttactactgagtattattatctagtagatactacaggctcgcaaatgtaaggatacggtctagtcttactattagctatcttgatagttactagttgccctggactgaatcacagtatattggcttactccaacagtgacgcctccacttctggcagaactccaacggcccggttggagtaagtcgtgtggaaaagtgggggttgcgctcggggcgatggagatagccaactagtatacctagtagactagatagacacacacaccccagaaatggactattgagctatgctctagtagatgccgtacactagctgcgccagatcttctcaatggcagtcgctgctcctaggaccttctcctcttctagcttcttgccgatgatttgaacattaattggatgaccgttcatggccttcgcatcgtacagcccccaattccatgcgtccagttcgttcctgggttgatagtctgctggcagtgcgtccacttcagcccgcacctgatccactgggaatgtaacagcagagtagtcaaggaaattccagattttggtatacccaacccaccgcagtgttcggtggggaatagcaggatggggcgttgtcggggccaggagtacatcaatgggtttcccagagggagagcgtgttgcgttccatttatccaagtatttcttttgcagtgcagctttcttcctgttgagctgccagtactcgtagacggaaatggccttcccgcgatttaccaatgcttccacgtggggaatataaggctccccaccagcttccacatcgcggcggatgtcttcccccccatccactgtgtagaaagtgtccatgagttggatatattctagatgatcggaagcatcccagacgactagctcgtggccttgcgcttctagtcttgcggaaagatcccgaagcgctctctcgatgggaggatgaaccttcacaactccgtcatccaaaataagcccaattaccataggccggttctgaacctcctcgtatgcgctctcattccagagtagcggggtacatttggggtctaactgccacggctgtgcattagcaatcagtcggcttacatagcagagagacgatagatctcgtgccatgggaccaacagatgagggaacatgctcttgcccctcggtagacaccggtacgccatggtacggaagtctactgctctatatggtttgtcagtcaggtccttttaccttatcagagctaggaaggtggttagacttaccgtaggcttcaggctatacaggcccatgtgactttgtgggattctcacactgccaccgatgtctgtaccataccccaggatagagccgtgcaatgccaatagaacagcctctcctccagtggaacctcctggcgtgaactcagggttccgtgggttgacggtcagaccccaaagtggattgtctgtttcagcccactaagttatagatttagaatctcgaccctctatcagcgagctaggcggatacaaaccattatgctctgtggtaggttggtcttcgccagtacgatagcacccatatctttcagcatctgcactagaactgcatcttctgtagcgggagcaaaagagcggcccacgtatccaagtgtggtgtcaacacccttgacattgaactgatcttttactgtgactggaatgccgtggagtggtcccttgacttgaccggttcgttgaaaagtatggtcgagttgccgggcctgttccaaggcatcttcgaacacaatttccgtgagacagttggtctgtggagccagacctattagtgctgatctacagaaatctttcgatgatgaatttgctcaccaactgatgggctaccacagccctgaggacagaagagtcagtcaggaatggaaatgaaggtagttagggcgattcaatttatatatagtaccttctaataaaagccaatgtcgtctgctcagctgtatatttgcccgatttcaggcattcgaagagcctgggcacgctgtcgatgtcagtgatctcctggattacagggtcttcttgaatacgcgtgcgctcttggacagagagcagctggggtgcacgccggtcgatatcgttgacttgatatggctttaggagctggttccgtagagcacgcttttgggaaacaatttgctcccacggctgaacacttcccattgtggcaaagatatttcaagatggttatcttatcgaagcataaatggggttaagatgtcctatttccgttgtcactttcgtcactttcgtcactttctccctagtatatatatgtggatgaatgtgagtgctatcagcagttgatgtccacaccagaactcatctgctagtgcgggccctaaaataaatgggagtcattaaatagtaatctggcagctctcggaggagatacgcaaagccagctagtgagagaccggtggtatcagttgaaggtggggttaactacggatcaagggtcaatgttagcgaagtcaggcattcgtgcggagtaatcgctcgaatccagtcatgataagaacaacgaccccatcgctagtagtagactagatcgatcctaatagagaggagtagattgcgtttggattgaaccttggctagtcaggcacgccgaagtaatcccggtggatcgctgatcaaccggcgaatgttttcctggggaggctgtccaagcggaacttgttgatgttgtggcgatggctcaaccattgaatccatccccacacttaatttgatgtgtaaactgtaaagaatataaactcaaaaagaggcgtctggggaaacatccttcgagaatactaggtttggggggaagattgagccgtcaagagagggagggtgaaaaaggattggattaggttggagtgggggaaatctccaccagggtcaatccaccgtcagtccacaggccacacgccggccagcttttcccttcgaattccccgtttctcctcacagcttgccgacgctttccatcactggctgcgagctccgaggcgtgttggcgaacaatttcgacctgttcacgacaatgcttatgactcgtgagatgcattgttcgatgtccctttatttgcttctcgattactaagttctttctcccaatttggcctcaatctgaggacatgccaccatgaatccccccaattctggtgccgctgcaacatcagcgatgaccggtgccatccgcaccgattcccgaaagaagtcctccggcgcaattgcgaaacgtgcgtgcgaccaatgcaagttccgcaagatcaaggcaagtaatatagtagattcctacggccctctttccgatccggggtccccctgtctgctttttctctttcttttccagaaacccccgaggtccacccgtgtttactatctttccgagcctggccaaccgagctaatcgcctccgtaactgcagtgtagtctatcccaaccatgccgggcatgtgtttccatgggctttgaatgcacctttttccagccgcagaagaaacgtggtcctactggacagtgagtctgaagatcctgcctgcccttgagttgcttattttcatgtttgttaatctgaccattctgttgcgtatccaaagccgtgtgtctcagatccggcagcaacagaccaacttaccggctttgaatagctcacagagccaagtagcttccaatcccttaccaggcgcttttgccgcctatcagacggagtcaccatcccgaggagacgggaactccaatcccgtacatccaatccaggatgccgcacactggcctatgcataatgaggcctcctcggtacccgttgagctttctcatcctcaaccaccagccccaattgcacctaattggagttctggggcctcccaaattgaaactcatagtaatagtggcgtcagctggaatgagcgcaatgatgtcgaatactggctgccggatacactggatgctcaggtacccgtattcgatttcccgggcagtaatatctacctgaaagcctcgcttccatctattatacaaacagacgctgctcctgcaggtctacagtcacacccagcggaggcagcaagtgtacccatgtcggggcccaatgtcctccacccgccgccaaatgagacaaacacgctctggccctcatccattgtggaagcgaatatgataccgtggattgacgtctattttgatcgtttgcatccaacattaccggtgctaaaccgttcatcactgtttatccgaatgctgtcccaggaacaccgcagaaacccgcaatttggtgcaatgcttctcgcattgtgcgcattttcccttacccaaccgatcgagatagccgagcgaccgacgtcttcttctcgagctaaccaagctcggtccatgatgaacgaagcgaccaaaatgcgaagctgctcggatttcggggaacacccaacagttgaagcggtccttaccagtttcttcctgtttgggtgcttgtttggcagcaaccagcataatgccgcatggctccgcctgagggaggctcttgatcttgctgctacaatgggcttgaacaacccggattcgtatcgagatttgcccagcgacgaaaagggacaacgcttacggacttatctggttctgtcaatcacggagaggtattatacatatggttcgggccaccttaagatagtcactaactagcaattcttacagagcttatgcattacagcgcagacatcccatcaccttctggggtcgaccgggtttcagcatgcggcctgttcatgacttcattcacactgccacccatagtctggtgtctggcgtcattgtccataacgaaaaggatgctgaaggaatgatgggcctcgcccgtctgatggaactttttgatgccattgacgaggatgttatcgattgctggaaccaaagatgcaacatcaacgctggctactgcgagaagctcacggaagccaaggctttatccattcatcagaatctcagccgagttagcgagtcggaacgatataaaggctacgactggttcgagcgctccaagtcaaccctcggcgataatcagggaaaccgcccggcaataggtctacgagaaacccaatgtgcagacgtctttatcacgaaaaagtggcttcagaatcgcatttgggtgctctgttccactcatgggctgctgcggcctgcatctgaacaccatgagcttggtctccactacgctgtttctgttgcaaaagagacgcttgacatctgtcgatccttgcggctgagctccatggaggcacacggaattggacttgtatgtgctatgttgaatcctcttccatcaaattagctaaccaagtaggctgagaagttgtacgacattgcagtcggcgccattagtgtcttgttcaatgtccagatgcctctcgcgaaaggcaccacattggcatcacccgccagagccatgcccaaccctcagataccgatggctggtagtcaaatagtctccaaaactctaacggaagattttcttttactgttgaacagtctgcggggtggaaaccatcctttcatggaaaggtatcgaacactattgagctcattggacggcactggtcatgcctggggctctcaatagtatgagcttgcatactgccggcatgcatgccttctctaggatatcctaaaattctctttcttcttctgtgttcttactttatatttggcgttctggttttatcacgaagtggtccaggaaactgttaccctatcctcttgttctggtctaagcgtactcggtacaatagaaggtcaccacaccacgctatggcatcgaaaacggccaggctgtagtgcactatcgaatacaatgccataggattaagtgttacaacttcgtatatctcacatagatgacagcactgacagatcaagctggctttcattttcagcttgctgctatggaggctttggagacttgggaattagagccagtggccttctcgagtgaagaccaatattgcctccatttccgtgcaggaatattggcatcatacattgcgtcgatttccacaaacttgcggcctttggtctctgggatgaaaaaataggcgaagaccagaatgcacgccatgcagccggcgaatacaagataggtctttggccccagatttgctgcatcaggcgctgttagctggggcaccactagagttgtgatcacagcggttgcttgggcacaagcaatggtgtaagccatggtgtggtgacgaagtttaggagtagccatctccgagggcagcagcgttgataatggtgagaaggaggacgcccagaagaaattgaacgcaaaggacaaggccgcgattgctatggctgattggcggtttcccttgttgaacgccagaccaccagcggcaaggtcgatgatgaagaggacactcatgcccgtcaatgcggtaggacggcggccagcccggtccaacatgaacggcgcagcgattgtacccgcaagggtgcaacaagaagctatcacggttaatgtgaatgggtctccgatgccaatcccggacaggaagaccgtgctgtatgtcgttgaaaggatgatgcctgaaatctggttcagagagtagaaagaaccggcagtcagggtgcgctgaaggtgcttcttggagaaaatttcccaaaaggacaccttcacgtcagaagcgtgcccttcggaaagttccatatctcggagctcctcgtcgactcgctgttcactgcaacggcgcagtcttcgcaagttgctgcgagccgcttccaacctgcctctagaaacaagccattgcgggctctcgggcaaaggcaaggtccaaatgagcagcaaagcaggaaggacacactggactgtcaagggaatcctgtacgagctcggccctgtcaagctgtgagtgcataacaccacaatggtgcccaggacacccgctactagggtcagaatatttatcaacgatacacttcttcctctcatagaggcagggacgacctgccaaacggtgagtgaggtttcttgagactctagagcaccgacatgcacacctctgctagatacaagggagccgtgccattggcaatccccgtagcgattccgttgataaatcgaccagaaacgaacgcacccaagtttggagccagtacctgaagcaagctgccgccgatggagattatatatgcaatcaacaaggggtacttccggcccaacctcgaattcagcggagaggcagctaagcctcccagaatcgaacctattagaggaacagaaaacaatatgctctgattacgagccgtcaagaccagtttccctgtaagtggctcgggtccttgatatttgtcgacctgctcatgctgttagcccaatggaaccatcctatgacgctgcctcaccaagggttcattgacacttacaaatggccccaatgcagccacaggtgaaattatcttgtcatcaaaaccgaacaccaatgaagctgagccgaaagcggcgcaggtcagaagcagaaagaagttgactgtacgctccttagacgaggttctgctgtctgaggcgaaatcgacatgctgtacatggctgacatctttcatggtatcagggggatgggtgtttgaatcattggccatcgcgactgtcctcatacatgtaaatgcaagcgattgaatgacatcgcaggcgccaatcaatcattcattatacttgggttgacctcatcaatgttggggaaacccatcagtctactctgtagtaggggatatccgcaggaaacaagcctagtagaatttgaagggggagacgcgtcacccagcccgtccccagaaagaaccgtcgccgcaggcccatgggggtgctatttattgtcataccaagcaatcctcttgtggaagatgggatgcagacactggcaaggtttctctcttgtggctccacttgccacgctagtggatcccacctccagccatcgtcccttggcttaaactctatcattagatagagattttacgggggagaatatggttggtgtccacgatggaaatacctatggagaatacgatgaggcttgggattcagtcttgccggtcctcggacagactctcccccggtgatttgatctaacttggtggtgttaggggtacgttttcattccacagtaacctgggtatccatgtttgaaatataatgggaattgacggagtctggggttcttttcgccgaagatcctccggggattgaatcatgccccacgacacgacaattcgagcaaggttcatcgtccactcagtacaggcaggcaagctcggctgcattggattttgcagcggctgccaattcactcccggacctcgagctttatcggtgggggttgataagaaataactacggtgacgactgattgcgtctggattcaaccttgcctgataggagggttcccgtcatgtctgtcaatggggaatactgaaattgatatgtgttcaaccttgagatcttgtcagcatctctaatgatcaaccacaaagccatcgctcttccagtttaaaaatcgagaatagttcggatggagcggcaaactagcccctcagatgacgcccagcgatggcagccatcctaccatttcactgccccccacgggtggatgaatgacccgtgcggtctaggttatgatcctgcaaccggtgtctatcacctgtcattccagtggaacccgaaaggcaatgactggggaaatatatcctgggggcacgctgtgtctaatgatctgctccattgggaggtttatccggagccatgtctgcagcccaccaccgaatatgaccgatgtggcgtctttacgggctgctttcgacccaatgctgtagatggggctccgaatgccctgactgctatatacacatcagtgaagcgccttcccattcattacacgctgccgtatgtgcctggctccgaatcggtcagtttagccacttcgcatgaccagggtttgacatggcagcgtctcgactgcaacccaattatagcacgctcacccccaaatgtcaaagtagcaggctggcgggatccttttgtgggtgcctggcagttcatgcgggaacagccggaagcttttccatcctccgacctctgcggtctgatctccggaggtatcgccggacagaccccaacagcttttgtatattccatcaatcctcacgacttacgacagtggaagtacctggggccgctggttgatgttggactcaatttcaacccctcccgttggtccagcgacttgggggtcaactgggaagtcgtcaactggattcccatgacagacgacgaggatgttactcggttgttcatcctcatgggggctgagggaggtcttgcatctgacaaaagccagaaaaagtcacctcgagcacagctttggatgtcaatcaagccgtgctttagcacccaaccgcatagcaataccgaccctctcgcatcctatgcattttccggggtctttgatcacggttgcggctatgcggcaaatagcttttgggacccggtcacaggccagcagatagtctattgctggattacagaagataacctgccagatgaccttaggcaccaacaaggatggagcggcatgttgtctatcccacgagtagtgaaactaatcactctgcgccatgttaagcgagcccggcgttcagagctgaatgctatcacctcgatcgaaacagaagaagagagacaacaaaccttcaccatccgaacgctgggtgttctcccagatccacgacttaaagctcttcgcagtaagacgaacagcatgcatatcgatcacctgcccctaagcaaatccgacaatcgtatctctccacccaaagcccactttcctataacgacatccagatgggaagtccatgccaaattctccgtcagtaaccaatgcgggagagtaggcatagaagtcctccatggcaccagtatgttgtattcatctcccccacactggcacacatcgtagactttcagctcttccccactaacagtccaccaacacaaaccagccctttcagacccgccgcgccgtactcttctatactgggacccagccagcgaaaccttctgtatccaacgaccaagtccgcatgacccccgcatcaatcatgaactagtgaccgctgcccatacgctatttacgtttgaaaccccatccggcgaacaaaaggaagaggcgctacagatccacgcattctgggatacgagcgtgctcgaagtgtttgtgaacgagcgcaccgtcatctccacccgcatctatctgccacctgaccaagcgtcccagtgtgcactgcgtttcttcgccgagggagagaccgaccatgatgatcctccggctgtggttctacaggcagatagttgggatggattgggcctcgacaagcatgattgtgtctcgttgatcgagcaattgagaacgaggaagaagtcgatgcgcgagtgagataccatgctagaatcagagagtcatgacacatgacagagcaattaggctagatattggaaaattaagaattatcgtaaagtcgagcattaacagctatgactctagctatcatatgctaaagcttcagtccacagttccgtttgactctcttttaatacacgtatatatggcatatgcccccgcccccaaaaaagaacctaaaaaataacaggaagatgagactccacccaccgccataagttcgatgatgatatgcaaagctgaaaagcaaatgcttcgaatccttccccacttgaaccggcctttccgtcatgcaaaataaccccggataatatgcgaatgggtatcatgtcagatgatcatcatgggagaccgtccttccttccaaccagccagctaaagcgaaccgttatataagataccttgtcagggatgaaacagaagagaaagaagaatgagaaaataagctgaaatagaaataaagttatataataaagaaaggacaggcattcatagaagaagaaagaggaaagaaaagtattataagaaaaacataaataatagtggtcatagcaaaactaatttaccggttgtttgttgttgctgaggggtcatgaagaggtaaccggaatggatctcaccggcgttgccaaaacttccaattaggaaacgcctttcgtccatcgcgtttgtagatccgccaataatagacagggacaccggcgacgatgaaagcgacgacaattaatgtctgaagcggttctgcaatgatagcccggctgaggaggaagagactaacgcagcagaagatgatgggagtggaaatccaggtcttgtaggggcgatgcaggtagggttcccgcacgcgaagaattatcaggcctagcaccgtcacgaagtaaaaggtgtacccggctaccccgtaaaaggtgacaagggttttgaattcgccgacgatgacgtaaatgagggtgagtgtactgttcagcgccatggcgtaaatgggggtgaagccaattcgcgtgccatctccacagaggcgcgaaaagaccttggtggcccaggagcggcgctggagtcggttggtggaggtgtctcgagtccatagtttgccgaaaatagaggggagatagccctcttttccggctgcataaactaaacggccgctggtgaaggccgtggcgttcaaggcgcctatgcaactcgcggatacgatgagcgcgaatataagggctcccacgtgaccaaagaccttgtcgccgaactgaatggcgacggtattggtcgcttcaatagtcgaatgagggagaacgagaatgtaggagatattggcaaggagataggagaggatgactagtggcatggctgtgtggatcactcgtggaagatccttgttgggattcttgaactcgccagtcacgtagtttgtcttggtggagtcagtcagagatgaatgttgaatactgggtgtgtaaaaaacgtacgttgtcccaaccgtcaaaggcccaaagacccgcgtacagtgctacagcccatgcggatatgtcgaggttcgtgccctcgaaccagccggacttccattccttgttggcactgccagtcgatgagtgacctgtgatggccacaatgataccgatgatggtgacgcccagcaacgcgacaaacttgaagaacatgaagaggtcaccaatgcgcgcagccactctagtcgaaatacagttcaacaaagtcaccacgaaaatcccgccaaacgcaacagccttgtttatccagggatttaccgtttccacatcggcgccaacgaaggctcttacgacgtattctccgaagatgattgcgatgatagccgcactgcccggcttcaagaccaaaactgagcaccacgtgaacaggaagcccgccagctccccgaagattttagagagatagacctgggagcctccgttcaggggaatagctccgccgagctctgcatagctggctgcccccgtccatgcaagtaggccagcaacaacccatgcaatcagcgacgcaccaggcgaccccgcattggcattgacctggctgggagatgagaagataccggagccgataaccagcccaatcacgagagatagaccattcatatatgtcaatgtcttgttcctctccaaggacccatcagcaactccggcctctcggtcagcggccgagacccccaacggtgcataaccaccggtcgtctgagacaagggaaacaaggtcgccccgaaatcaaaggccgaggatatcgagtatgagcgagccgatcgggggcgccctgacgggccctgtgactgtggattggagctggaaagaggatcttcatcttcgagggagagcttgcgcgacgacgaaatgccggagggcgacgaggagcgggaggatctgggggcggagtcgggcgacgaggctaaagacgccagttcgagggaatccctgggagcatggtaattgcccgacctggactcggaattcgagaaggttatatgggacatgccgcccaaagaaggtcgaatcaaagaatggttgaaagctggaagagcgaaagcgggcagttaagaaggatggggcacggggcagtgttccatgccacggggagcaacgagtgggcgggcaattcttcctcccctaaacaaaacaatgggggtcagcagatgagaaagagacaagaactagcggcttggggaggaagaagcatgaagcattgaagaagatctattgagggacaaagaagaaagacgaagggaaatgcgactccctgcgtccgcggcccaatggggcttagcgccatgcgatctccggtctgctttttatagcgtcatgttccacttccccatccattgccccaattttttccctatacccatgaagccccgcgctctccctcagggcttgttgcgccagttcaatgagtcgcccactgtcgggaggctcgtgagccgaccccccagacgctatgcttccacctcgccatcgtctactccgccgccgaagcagcaacgatggctgcgattcgccttcataactgccgctgcggcgggtattggtgccctggtccggtcgcaacagggtccagattcgacgaccctgaattcgatgaagttcacaccttactatttagtatcccgcgaaccggtctcatcgaccgggagctacttcgttcttcaaccaccggcggccgatggcagcaaccatgccgtctacgagggagcatggaagacaggcgtttggagtgtcatgttcaaacagccacagttgcagattgggagagactacactcctctgcccgctacttgctcggaggatgaagaagacgagtgtctacgcttcttcattcggaaggacccgttcggcgaggtctcccgctatctacacagtctagagatcggagcacccattgaagtacgtggcccgcgaatcgaatgtgaagtccctccggatacgcagcgcatcttgttcatcgccggaggcacgggaattgcccctgccctgcaagctggacacacgcttcttcgccgcaccaacgaaacgcataagcctagaatacatatcctctgggccaacaggagacgggaagactgtgttggtggtgtgagtgacacaactacgactacaacaacagcaccctcaaggtcatggttctccggtctcttcacgtcttcgaagggcaaccaaggcggccctgatgaagcaccccgcagtacagccacttcgttaatagtccgtgaactcgaggctcttcgatcgcaataccctggacaggtgaccgtggattacttcgtcgatgaggaaggcaccagcatcgggaagcagctcatcctggactccacccgcagtggcccgtcttctcaggattcggaagaaagcaagaacaaacccaacttaatcctggtctccggaccggagggcttcattagctatatggcaggaccaaagctctgggctcaaggaatggaattgcagggaccactccgaggaatcctcaaagaattggacttgaaggattgggtcgtgtggaaattgtaaccataagtataaagttttctgtaggatagagagtatatagacaaaatagaccttcctccgtcttttaccccagaatcctccgatagcggagcaagacataatgcgtgccgtgtgattggtcgatcattcgggtctgggtccgcgtcggggcttccctttagtttgccttcaagtgtgaactttgagtcactcaactttctcccattttctttctttgctctgtccttcccccatccttgacgcttctgtctgaagatgcagtcgcgtttgttgccctccggccctggcaggcgctggatttctcttcgcgtgccgaacacgcctcaacgacgtgccttcgcctccacccgcttccttttccaggatgtcttccagtcccagctggacgacccttcctccgccgccctcttctcctccctgcagtcctcccgggccgtgccccagaccttgacggaaaagatcgttcagaagtacgccgtaggtctgcccgatggcaagtttgtcaagtccggcgactatgtgactatcgctccccaccggattatgacccatgacaactcttggcccgtcgcattgaagttcatgtcgatcggtgcctccaagatgcacgatcccaatcaggtcgtgatgactctcgaccatgatgtccagaacaaaacagagaagaacctgcaaaagtaccgccagatcgaggagtttgccaagcaacacggtgtcgagttctatcccgccggtcgaggaattggtcaccaaatcatggttgaagaaggctttgcctggcccggcactctggtggtcgcctcggacagtcacagtaacacttatggtgccgtggcctccgttggaactcccatcgtgagaaccgatgcggccagtatctgggcgaccggtaagacgtggtggcagatccccccagtggccaaggtgacttttaccggtatcctgccccctggcgtgactggcaaggacgtcatcgttgctctgtgcggtctattcgacaaggacgatgtcctgaaccatgcaattgagttcactggctctgaggaaaccatgagaagcttgcccatggatagccggttgaccattgccaacatgacgactgagtggggtgctttgtcaggactgttccccatggatggtgttctgaaaggctggttgaagggcaaggctaccactgcggccatgggcttggctgatgggccgttcaagaccctggctgctcgcaacttcacccaccctgccatcgagcagctttttgtgaaccctctcactgccgataagggtgccaaatatgcgaaggagctcttcctggacctttcgactctttctccctacgtttccggccccaactcggtcaagattgccacccccctcaaggagctggaagcccaggatatcaaggtcgacaaggcctatctggtttcctgcaccaactctcgggcttcggacattgctgctgctgctaaggtgttcaaggatgccgcggagaagaacggtgggaaggtcccgaagatcgctgatggcgtcaagttttacattgctgccgcgtccattcccgaacagctcgctgcggaaggagctggtgactggcagaccctcctggaggctggagcaacggccctccccgctggatgcggaccttgcatcggtctgggaacgggattgctggagcccggcgaggtcggcatcagtgcgtcgaaccgcaacttcaagggtcgcatgggtagcactgaagccaaggcatacttgggtagccccgaaattgttgctgccagcgccctcagcggcaagctgagcggccctggctggtaccagccccctgaagggtggaccgaagttgtccgcggtgagggcgatggtatccgcgaggaggaccgcatgctcaataccgagcaagctcttgagaagctccttggtcagttggatgaccttgttgccgatggggagaagcgcttcgctccggaggagaaggttgaggaagagggtggcctgacggaggtgtatcctggtttccctgaacgcgtctctggcgagattgtgttctgtgatgctgacaacctgaacacggacgccatctatcccggttactggacctaccaagacaatgtccccgtggagaagatggctgaagtatgcatgtccaactacgataaggagttcgcctccattgccaaggagggtgacatcctggttgtcggatacaacttcggctgtggtagctctcgtgaacaggcggccactgctctcttggcgaagcagattcccctggttgtttcgggtagctttggcaacatcttctcccggaacagcattaacaatgctctcatgggtctggaggtccctcgcttggttagccgtctgcgcgaggagtttggcgacaagcagcttacccgtcggaccggttggaccctgacctgggatgtccggcgcagtcagattgagatccaggaaggccagaacggacccaagtggactcacaaggtgggcgagctgccgcccaacgtgcaggagatcattgcgaagggtggtctggagaaatgggtcaagaacgccattgaggcgtagagcaagtggttcagcagaaatgaaacgcgcatgactgtcgacaaagtgattcttatgatacccaagccttccagtcttcgttatggggttgcggcgtggatgtttcttggatagagacgatacgcatggaaaaaaatatcaaactcaagagatgactctgcatgtatagaaaggaaagagatttcccttattagatgtactccagttcacgatcaatgtattctattttctatattttttttcttactttttcttactttttcttccagttctcggtgcctagagagaacctgtgtttttcaccagcattgggggaaatgtcccgctgggtcacatttgcacaccctcttgctttcatcttcctccatttataccctatctctctgcatcagccattcccaccatgacgatggatatggctatgccaggtccagaaaacaaggatgaccttgttgtttgctgcggggaatcagacgaggtttggggcggtgttttaggacgatcgccttacaaggtttagaacacgggcactggcgtggtggcctgcagttgcacggctcactgagcctgtcatgattcgctccagctcagatgccttcagctgtcaatcctctgctggcttccttccttcagctggcattgttttcttttattctgctctcctccttcatgatcgatggactctctacggtcccccccccccaacttatgatctgagcatccgaaaccttcaatttgtatatgatcgtatactcagccccgctacgctgctgatgttcccccaatgaggtgtggctaccggcaatggatcctgtcaccgcaatcggtctgctttccggtgcgtttcagatcgctcagtacgtcaaagacaccgcgggggcactggcccatctgtttggcaaattcaaggatgccgacctcaccattcgatcgcttatcggcgagctgacgaccatccgatcagccattacacagctacacgagtgggcaagctacaatgttcgtgactcaatcgaacccgacgagtatgtcgagggacttgaagtcgcattggacggctgtcgcgccgtcatggaggttctctcggacgaggtctcagctctgacaagaggtgcaatgctgagtgacactgggatcggatttcgcactcgagtaaaggtcgtctggaacgaggacagcatgaaggttcatcaggaacgactgcgtgcgcaggttcatgcactgcagctcctgcttcaagcctgccaatggtgagtctggaagttgacgaagcagcaatagattactgcatactaaacattgtgcattagtcggacatcaaccgagcaagtcgaactgttacggagagcggaaaatcgccagattattgcgaaagtcgccagcgatacagcaacactacggtccgcttacagctacgtaccctcacgggcggagactccgagcctgactcgtcgctcatcctccgtaggggacacggtttttgatttcgatagaacagtggtgacttcccttccctatagacgcgcgatcggacaatcacggacccatcctacgacgcaagctgcggtcaaccgcagcacttacagcccacctatagatgaagggtatggaagtggtactgtgagtagtgcaagccctcccggaacgagtggagttctcccaatacatccctctgcgtcgttcgactctagccatggccacagtaagagcgtgtcgttcgcaccgactcctttaccgcagagtccgactcaagtccgcagatggcagtcagatgcgagtggcgcttcctggggtaatcgctcctcaggatcacggcgtgagaagattcggtccatcattcggcaactcaggcgtccaagctggtcagcgacgcaagcttccgtacgagttcctgggcggagtccgtcggagcgtcggctgtacgaaagagatttgaatactagcattaatttgacatcaccggatggagcgtctgcgccgccaattatcaagtcagcccagtcgggcagtcgatccgatgtcgaaaggctcctcgaaagtggtcatgacattgaagcccgtcatatcccgtcgcgcaggactgcccttttagtagcatcccattgcgggaatgaagacgtgctggatctactgctgcaaagaaacgctagaatggatgctaccgacaagtcgggttccaccgcgttgcacttggctgcgtcgcgcggtcattgcagagtgcttgaactgcttcttcctgagtgcttagatatcgaagcacggaatgctaacggccagactgctctctgggtagcagcacatcatggccaagctgaagccacaaacctcttacttgcttgtcacgccaaagttaatgcgcgagctaatgatcaagcgacgccgctacatctggccgccaaactaggcgatatagtaatagcaaggattttgatacaaaacggcgcagatttggaagccaaggacggaacgatgatggcaccactacactacgcctgtgaagggggacatctggatgttatggagctgctcctcaatgagaaggcgaatgttaacgcggctggaagcgaccgaaggacgccgctcatatgtgcagctgccctgggtcagctgctggcgacgcagcttctgcttaaaaagaaggcatcgactcgatcggtcgacgatgctgctatgacggccttgcactgggctgcttataatgggcacaccgagatcgttgacattcttagccagaagaaagggttgctggccagaactaacattgcgggacgaacagccttacatctggccgcaatgaagtcacagttcgcggtggtggagctgcttcttcggaagagtatgccattagaaaaccgctgcctctcgggtctcacgccgcttcactatgcgtgcatggctgataattgtgaggttacgaagcttttgcttatctcgggcgccaatatcgaggcccaagctgattcggatcaacgtcgaccggtccaccttgcagctgtccgtgggtcgatggcacttcttaatttactctgtgacaaaggagcttctctggatgcccgtgacaccgcgggagatcgagcgctctgcgtagcatctcggtacggacatgcggccgccgtccagaacctgctcgaccgcgggtccccagtatgcctgccttatggcgtccgatcggaagaggattcgcctttgtgtttggccgctatgggaggacatgtgcccgtggtcacgcttctcctccagcgaggtgcgtcagccatcaagcgggacgaacgaggatggcagccctaccgctatgccgcttactatggccatccaagtgcgcttcgtctgctcatgtcctgtagtcccctagttgccaaagacgatgcagatctgggcctcacggcagagagaatcggattcgcgccgtctgcggatatatctattgaaaggaagcgagaagtacaaagcttattgtatcagatgcagcacccgtcacagccaggagccgaaggctccccggcctggtcctttccgctaaagcccaaccagcagcacccagtaccttctggagtcttgtccgatgtcgctgtataccatacccagctgtctccgacggcagaaacgagtcctcaggagctgccagggactttagaacaagggctcccggcaagccggtctcagacgccggagcatatgcggcgaggaagtagcatttatcagcgcatagactctgaattccgcgacgtcccgcagatcctagaggccaatgagcgggcctttgccccaaccaatgaacagatcgcgatgcctcaagcgcgacattactatcaagtgcccggaggaactcctagtccaagcagcccgtttctggaaagtgtgttttcgcatgcaggcgagagggttggcgtccgcgccacagactcgcctgtctctttgacagatgtgcatgggctgaaccctccgcgcgcatcttggacagcacccctgagccatgcaggcggggagggtcaaaagaaagaaagagaatgggacacggagtcttctatatcatcagtttacactgcaccggaggaagaggttgccgagcttgctgcctagatttacaacgtataatattacattgtagctagatcatatgtcacacatacacacacacacacagagagagagagagagagagcgcgatccgccttacggccacctctatacgagaatttcctttctatggatctggttgagtcactcccggacgttgacccaaaaatagcagcaatataagcatgtggcatcgcatggcatctctccgccatgtggccgggaggaagccttgacccatcaaagtcaaaaagaaagacatgtctcagactcgtttctttttctcccacaagcctcaggctgattgctctagtcatccgccaggatgaaacgtggctgaggatgacgatggttcatgcctttgtgcatccaatcagccactgcgagggtaccaacacctctagctgtgcagtatgtctcccagggacagaaaagtctcattggcgcagcggatatgctgactcgaatcccgagtttcctcaaactgtgtctgttatcttattcttatccttcaggccgtgcgtatgatgccgtgacgaagtataatcagctgacctgaccttattgacaaccaccgactaaacagttccatgccagatgataggaggaacccaactagaccaggcgagacaaaaaccaacaaacgctagtaagtagttagttaaaggttacacctgagtcatgcattcaagcataaaaaaactctcaaatctagtaaaagagaagaaaaagcaaagcgaaaccataccaagccgaatccaggctttgatcccgtcttatcgactatttccgaatcttctcatacggaaggcattggtcctgaggcttcgattatatttagcacattggttggttagctagatagtcagtcagtcatttagttagtcacgacggtagcactggggatttgaaatgcaactctcgtcaactatgggatggggtgggcctgatgcgtattactcgaggcattttgtaggactacaactttatgagctcttaactgaggtacacttggggcttaggagatgatgcattagtagtagtactgggtgtatatataaagggttcttgtgcccggatagatagaagcttgagcagactcactactactactactactactactactactactacttgcatgctatactaataataaacttactctcgctactacttgttcttaaccagtcaacggatatacaacactctgagatcgtgattgctctcttcattttgtgccggataaatactatacatacatcgctctttttgcagagtaatactctatcaccaccatctattatacaaatctgatcacacaagaccatcaccatgggccgaggaggatacaacgcccccgagactactgcgccaacgcccgcaccgccaacttcgtcctctttttctctatctctgtcgctgccgctgtcgccactttcttttgctccgctgctcctgcagggtcgtggcgggtacaacgagcaccagcccgtcgcagaggcggtatagcatacgacgcaccatagaggacatcatccggatgggagagcatatgtgctttatgatttccgatatcattatatagatctccctcacttgcccacacagaacctattcgactcagtcagcaacaagaacaacaaaagaaaaacagcactctaccacactataatacatagcaacttacttttcaaacacaacgcccagaacatcttccacgtctccgctttccccacggcccgtaatcttcgccatggtatcagcggcagagcgcaggtgttcagcggcggtgacgatgtcaatgtccatgtccatgtccgtttctgggaattcatgagcgaattggcgagatgaggaaggcataggcgtctgggattgcggttgagtttgcgtcaggaaatcatctaggtgttcgagacagcgttgtaaattagagctttggcgatgcgtcacgccgagtgaatcttcccaatatgcatgatcgtattttccgttctcgtccccatcgatgcctgttggagaggcgatatcctcgaatgtagtcatcagaccttgtagaaattgctgaatgtagccgggatcggagagctggctggaaccggggctggtgaggttcaggccgttggtggcatctagacaggagatgccgaagatacgctggcgctggtccggggccgccttgaagagttggctgactgtctcgatgagctgcgcgggcaatttaccctccggtaatcggtcacatttgttgatggttacgacgacgcacttgccggcgcgagcgcagtcgttggctgcgtcgacgacctcctgctcgacggcgaggcggtacgtcgctgtaccatcggtggcttcttctactgagacgaccacgatgaccacgtccgattccaaggcacgtgcctttgcccgtctgatgccctcttgttccacggcgccaatcacaaccgtcttcttctgtccggtaggatcatttggctcggagcgtatccctgccatgtcgccgagcttgcagtaccagccgccgatgtcgacaccgacatccacgatgtcccgcgtggtgccttcctcagtgctaacgatggcggcctctctgccaacgattcgattcaaaagcgagctcttccccgcattcggggcccccaggagagcgaccttgattccgttacgtaggagctcgcccttggacgcattctggatgtgaagggcgatttgagcccgcagagcccgcacctgagccgcaaccgaggacaccaggtcctcggtggactcgtcgaaatgctgatcctctgagaagtcaatcaacgcctctagttcgccgcgcgcatagagcaattgatgtcgccattgttcgtaccgcttcgatagcgcatcgctggcaccccggacagcaagccggcgctgttgctccgtgtcagcggacaaggtatcgcccagggcttcgatctgcgggaggtctaggcggttgttcatgaaggctcgacgggtgaactcgccgggttcggcgtagcggactgtgtagtcagggttgtttgtacgcgagatggacgacagaacggatttgacgatggctgggccaccgtggaggtgcagctcgagaacatcttcgccagtcacggtcttcgggccggggaagtataggactaaggcgccggcgtcgaggacggtgttgggggagggtttctgggagggatcgtacagggtgcggacgactgcgaggcggggccggggaagaggtgcttctggacagagagatttgtagatctgcgtgagtgagtgacgttattagctgccggcgctgctgagctgagtcgggaggaaattcaatggcagaagtgagctctcatacttgcacacatgcaggtcccgatgcccgcacaacggcaatggcagcccgtccagatgctgtcgaaagcgcatatatggtggaatcggcatcgaatatggattgagctggtgaggatactgagaagtatcgacgcggaggcacacgcggagacgagctccgggcatggagagctggaccagcgccctgccgggccacggtgaagcacctactccatgatgggcgaaagggtgtcgcccaccgcagggtccggacggccgatgatcgcatacgcgagatgaatctaaataggcgcaatgggcaaacgaagagcaattgccgatcttcgaggcatgagagaaggcgagtctcaacaatgagggtcgccgcatcgccgcatcgccgaggtcacgtgataccactgcggcggaaggagaagtgtctctttattatagttataatattgaagtgaatgaagcaggtgtggttcaagaactacagtagcagcctatgcaagacaaggtattcatgtagacagatccaggaatccagtagatgtataaaagccagatcacaagggccctgcgccccttcgccacgcctgcgcgccgaaaagacacaaagactcggccatgcgccacggattccttccccgtagccaaaatgcaatagcggctcgaacgacatgcagatataaacgaggaatgaagaaaagagcagagcgaaaggaagtatgtacacaaagagatgaccggagcaacagtggggaagcaagaataggttagaagtatgaagggtgattgggaatcgctagaaaaaggtgaacaatgtaccttcgaagaaaatgcggagggatgcccggagaaagtaagaaattcagaaagccaggcaggccagaaaaagaaagggggtaagttcatcctggcatagtatacactcaaaacagcataatgagatctttccgagacgacatgagttagtctatcaaacattagattaggaaagagggggggaggaaagacactccttgcggacaaggaggaaaggatgcaagataaaagaaaaattggcaatgaaatgaaatcaataaaagaaggatgggagtagcaaagcaatagttgcccaactactcaattgatctgctcgacggtgagccttccatcggttcatcgtcaccaggcgaccgaagctgttggtccgctgtgggtgataccacgattgccggcgtcagaggcggttgaggaaggggatcgtctccagatcgaggactcgctgcatcatccggctccagctcggttctgggaggtgaaatgggttcgggcacggaggtggccgcagagccctcagcgctgttattgctggtgctgcctccatttcgtctccgtaacctgcgtttccgacgctcttcttccgctgtttctcggcgtcttctcattcggtcgccgtccatgttatcgcgtaggccctgcagcatgctcgcggcacggtctgccacgtcttcgctctcggatacatgttgcggatccttcttcttgctctcagaagattccgcttcgaggaggggaggactcagcaaccccaattcggcggcatttgcttcgctgtcaacgtcgttgcccgccttgttgctagttccatcttcttcggcttcattccctccttccggcgcctcagctccagcaacatccggcatcttctggccagaagcaacgcggatctggtgtcgctcctttagcctagcacgacgacgacggtcacgctggtctctggcttggggcgcagcggcgcggagcttctccaggagcgaatccatggccccacttgtagctggcgacggtggtgcgtcactagcagaggcggcgccattagcaagaccggcattgatattccgcttgcgagccaaggacgcctcggtgcgtctccggctttcttccagcgaaatgttcttctccttggatttctgcacagccactggttagcaaacattcttaagagatacttgacaatcaaacttaccttccactccagcaagaaggaagccagctttgcgaagaagtcccgtcgggcaccctcatcggaattatcttctccatagaagaccatgatgtcatcgtaggattttatcatctcatccaaatagagctgcatctgctcggctttccgtctagcatccttcatgctccgctgaacgatctggctaacgcgatcctgggggtggaacttcttggggtcactgagatttccggcgtctaagctggcctgtacattcttgatgttgtcaatgtacttctttgcatccgtccgcagctggtcgacgttgagcttctgaatagcgatgacaccattgatctcgtccacgaagccttcccattcgggatactggttacgaacaatgcgctccaccaaatcagcaaaagtggtctcgttcttgtcatccttgaccatgcccagccgggcaagagagctcagcttgaaaccttgagcctgcttgttggcgtcgttcatgaagttaccaatgtccaggatcagacccaggacgttcatcagtgaaacagagtctctcagagattcgctgacctgcaccacttgttgcagcttggcggagatgtgctcataatccacttcgaaggaccgagtcagagcgagagcgcgcattctcgccttccagtagtggttgagctcgtacgcggtgtataggtagatctgatcttccctcgtgagctcattggggtcttgctctcgctccgcactagcagcatcggggccagtccagtccctgctgtagggcgccatcgacttggaaatattctccgggattgtgcacatttcgtctcgctgcaggaattccatgacgacctggttgtccagaatgtctgtgtcgcaatggataatcatgcgcaccacatcgtcggcggggaattgcgagaacttggccattgcgatctggaagttcttggacaactcgttggagatgagctgtttcttgtccttgcgctgcttggctgctgcattgcctccaaagatcttggtctccttcgccatgaacaatctttcaacctcatccaacacacccttcttggctaactctacatatttctcttccttctcctgtgcagtgggagcgtgagccgcccacaccgtcacctgtggagtatcaaccttctcccagtgaagagccttgagcttcttctttggccggatagagggcataagagctgtcttgtgttgaggaagggcttgagaggccatgtagttggctcgccatccgccaaagcctgcgccaggaggaggcgggggaggcggagcaccaaatgaagcacctggcggaggggggggcggcggcggaaatcctgcaccgcccggaggagggggcggaggaggtggaggggggattccaacctttcctcccggcggcggcgggggaggagggggcgggggagggattccgacagcaccaccaggcggcggcggtggagggggagggggtggaggaggaatgcccacagcgcctgggggaggaggtggtggtggtggcggcggcggggggggagcgggcgcccccttggcctcgggcttctcgatttcactctcaatcttgggttcgtcgatgacaggcgccgtggcttcgggaacgtcaggtgcggcttcgttgtcgtccgcgtcgatcttaggaaccttcgaggcaatttctccaaggaggccgttcgcctgcttagggttaagtcgtggccgatggaggtcgaccagacgcgccttctcgtagatgatctctccgttctcatccacctgaccctcctgctgctgaccctcgacaatatccttctccatgccgggcagatggcttcgcttgcgctgaacagatcccagacccgcaacgtgatgaacctggtcttggaacccatcttgcggtccaacatcaccgtccatttgctcacgaagttcacgcagccggtctgaggtcacatgttgaccccataccttgccctccaatttaaattgggtcttggtgcgctcgagctgcatctccaaccgctcgaggagcttttcacggtccatgatgcccctcatatgggatggatcgacttctgcgaggttgttcttctttgcatttgaagcggcgatgtcctgggcgtcccgaagcatcaggtagagctctctagtttccagttcgttccgttgcaactcctgggcgcgcaagcgttgaacatcggcgagctcggcccgtattgactcctcccgtctccgttgaagttcgatgatgccagtctgctcttcgatttgcttctgcaacttcttcactaggccgtctgcacccagctcaatctgtgccttcatctcatcccgctctgccaaagcagcctccgcaatctggcgcgcttctagggactcatcgtacgcctgtcttgcctctgaatctgtatgtaacttatccaaaaggctctgcacggtaaatgttaacccttggcggagatccagatcaggtagcctgcggtccatggccacgtagctaagcatggcgtcgacgagctggtacatccggagaccatcttcgccggaattctcccggatgaggagcatgtgttgcatagcagagagaaagtagtcgtgagctcgagtacctgtgatccttgacgcaatagcgtctgtaatttgtagaggatcgctcatgtccttcacctcgccctcgatgctatccttcacgctgctactctcgcgttgcaaaagatcctcgtagtcgatggcctcattctcgcggaagcgctcaatctgcttgtcaatgacctcatattggaagccttccattttagtcatgagacgcttgatgccgcaagaggtgaactgcgcacgaatatgacagcggagctgcagatcgttctccggggcgtccaccaacatgttaatgaggagcatggttgagacggcatactccatgagaaggttttccatgcctataccaccactgcggtattcctcgctcgcgcccaccagactacccatctttccacggccatcgatcgtcacttcgacgatacgcatccaagcatcgaaacgaccagtctctccatggtggttcttcacatggtccatagcctggaggaccttctgatggccctgcccttcggcccagtggcaaaggaaggtcaagacttcactgaccaacttccttgtatttagtcggggagacagcagcgagctgacaagagcaacaataacctgctgatgggcgagggcatcatctgcgccgtatttgttgttcatcaaagcctttaggcacttgacgatatcatattcacgatccagatccttgtcaccagtcgggggtgcaggaacaggacctgaagcttttctccggttgatcttggcaagaacatttgtcagggcaatttggccttgtgcttcgacaaaggctttcacccaactgattggttgtgtgcgcagactgacgctcaaactagctaattgtttcgacgtgattgagtcatccataaccttcttcacgtaccactctgggcttccctcttcatcggcccgctccagaatccccgacggcccgtcatggccatgggtctgccgggcattctgcctgcgcttttgttcgccttgaatttccgtcaaccgatcttgatgaacaagggtccactttttcgaggctggatacgcaagcatctgccgcttggcctgctcaggcagattctgccaacctcgcttctgcatcagttcgaggaacagctggtccacaatgcgatcatcccttggacgggtcaagtattgctcagggttgcttggtaacttcgcaggttgcgcgggctgggccgactgccacgcagcctgcgcattagaaagtcggctggaggtcccattagatgagtaggtgttgcggtcggcagagtgggaggtggtcagtgttcgagatgaaccgtccgatgagaaatagctcgaacctctagtgtcccgggtattggaagaaagtgacgagtggacactagcctgatcgaacgatattcgggaatgcgacgaggaatctactgtagatgaagagttgtgactgaaccctgtgttggcagccgagctccccggtcgtccccattgttgataccgagcacctttgtcccccgaagagcttcccgccatggttacgttagacgcatgtggtggcggacgagggccggtggggtgagaataaacattattgtcccggactgtggccgggttccaagcgggatactgatggaaatcactgcctcccttggcaagatgattcggggacggttctttgcgtggcgaggtttcggctttggagagatagtcgatgggaatcggcgacttggtgtcggcggggagactttcaaaggggatggaggtaatcacacctgccgtcattgacagcgctgcaggatcgatgtcgttggaaaaatccatggactggacggaggatcgtttggaatggcgagaggaacgagaacccggggcgcttccaggaggcgcgagagtctcgaagcctgtatgggcatcgtggcgatcgtctaccggtttctccttgtgcaacttcctcccgaagaatgatttcccagcggaagtctgtctcgatttgtcaggcgcggacgtggtggttggcatcttgacggacgtcgctggggagatgcagggcgcagcatgagcgtaatccgctggggcaagagcgttgaggtgacagacagtcgtcggaggttgtagattgagaaggatcggtcgctctcagtctctgcgaaggccaggatcacatccagctcaaggcgacaacttattccagacactcctgactaacactaattaatagccgctgcggagcagcgttggcacgaggggggtaaaggatgccaccaaaggaaagacggacgcttctcccaacaaacagatggagaaggtgacttgaaggaatgacagtcaaaggagcggtctgtagtgacggctcccagtagggctatcctactctggcaaatcccaggatcgggctttagtggctggagtctttttgcacgtcaggtcgtggaagcacgggcatcagggggggcagcaccacttgaggcggctctagaacgcggtaggggccggaggtatcacgtgaattacaccattcatgcctcaggaaactggccatcacttcccgatcacgtggagttgtcgcacgccggagactcccggagatgctgtctgtcggtgtcaagattcagggcaaacccccggattgctgctgctgctgctgcagaagaccgcctggtaagccagcgttgggagacggtcagcctgccagtcacatcggattaccctaagtgccgtcgcaggttatgacaagcccccgctgctaatcgggaatcattggcttaatttggcgccgtgtgttcggcgcctatctatctacttccttcccgctgctgccttggccgcgcattctcgagatcaagatccgttacaggaagggcattgagcaccacacgcacacacgccacgatgggttccgcaactaattttgccaaagtatgcgctcttctagattctcctgatctccggattctttctaacagacactctctacacagaccatcatcatccccgccttcatctccctaacgctctacctcctcttctccttcgtgatcatccccttcttccgtcgctatcatcaacgatactcgcaatatctcccacttcatactctttctgcgcacactaaaacactccgggatcgtatcgcggatgccttaatgcgacgattcctcccgtcggtttggcgacaatcacaattcgacgatcagcacgacaacatcagtatatatgatgaagaaggagagattatggtagggatggacatggacccgtcacggcgagaagcgctcgaacgccgacggagtacagccggggatgcggagagtcgattgagccgtgaactcgaagcggggttcatggatgacagtgatgatgacgagagacatacccatgctcagtcacgtcgctgaattctctcgccttctgtacatattacattaccatgttaaagggacaattggcgtttgggaagggtaataaatataatagacatctattcttgctgaacctttgcggtacagatagagcccaaggcacgtctgtctgaataaactcgatggcactactaagctacctgcatgcgtacataaaaccaatgcatgcactgataatcacctcaagggatatctactccgtccgtccggatttatctatttagtaactcaatcaacccaccccttacttcattcatctccaacccccacgtcgcaactctgttctccaacaccatccaactgaccccaaacaaacaacccaaagaagaaggtacatacccaactccccttcacatgcaaataggtccttttacccaacccagcccgacctaaagagagacagaacaagaaagaaagagaaagtaagagtagatcactaaaccaacaaaagtatattatccgaaactatacaaactcaatatctatctctcacttgcgagggagtaatcgtaaaactaaagcagtataatttcccactaaatcagaggctggtccgtggttctggcctgctgggaagtttgccgtggtcaagcttttgttcttttgggggatcggcgccccactctctgcatttatcctttttgcttggtggggagtaagttgtggattttgaaatggtatgatgaagaagattggactaaaatgacgagctggaatatgatccaagtccaatgttgagattcgggattggactagttttgttttctggaggagggggggttcctcaattgtgctagtctgcctggagtcctgtgttggtgttaggatgatcgcgggaagagtccgaagagttacaagtctacattaggacgtgagacaaataggaacaggaaaagattgaacagcaggaaaaagttttgatttcaggtatcatatgctaatcataacgggaggaaataggccgaatacaaatcgatccatgcatctcatcatcatcgtcttccatttaggccttgttgcgctgaccgtaggccttggtaacgtagtcaccgccgtggacgatgaggtcctcggggcggtagtcgtggcggccggagaagtagctctcgaggatggccttggtaccgttggcgtagcggatctgggcatcgatggaggtaccggacatgtgaggaaccatggcgttgccgccgccccaggggccctggacagtacgcagagggtggtcggcgggggcgggctgagggaaccagacatcaccaccgtagccgcggaggtggccagacttgacggcctcggcgacatcctccttgacgacgatggcaccacgagcggtgttgacgagccaagagcccttcttcatcttggagatgagctccttgttgaacagaccgcgggtcttctcgtgcagagggcagttgatggtgacaacatcacactgggcgagcatctcctcgaggttgtcgacacggcggcagccgatctccttctcaacctcaggggcaaggggctggtagtcgtagtagaggagctccttgcagtcgaagggcttgagacggcggaggacacgctcaccgatacggccaacggcaacggtaccgacgaccttgccctcgaggtcgaactcgttcttagcgacagcagcaacgtcccactcgccgcggcggatctgctcgtgggcgggaacgaagttgcggaccagggtcaggatggtcatgacaacgtgctcagcgacggagacgacattgcagccggtgacctcggcaacggtgataccgccattggtcttgttggcagcgttcaggtcgacgtggtcggaaccgacaccagcagtgacggcgatcttgaggttcttggccttagccagacgctcagcagtgaggtaaccggggtggaagctgttgcgggcaagcagtcagctaattaggtcccgtagttgccaagttcccagagcggataactgtgggtagtggagtgggtcacatacggagtggtgatgatgacttcagcgtcgacgagctccttgtcgaaagtcgagttctcgccctccttgtcggaagtggtgaccagggtgtgaccctgctcctcgagccacttcctcaagccgagctcgttctcagtggtacccagtagaccgggctgctgcttggcgtgctcaccgccctatttggagatggttagtttctggtgatttacgagaaaagaaagtgatgctattcgggtacttacgtcatagaggaccataagaatcttgccctgtagattcgcggaggcggttagcgtacgtgcaccagcgatcgagttagccaaaggagcagcccggaatgggctgctggccgcaggcgcgaaggctcccttggtggagaggagagaagtggcaggtcgccggagttggcgggagaaagagcgcataaataccattgtgaagatgagttaagtgaaataagataagatggtttagagatggaggagtttgatgctggttatgagacctatggcaggagggtcagcttgaggtttaaatacatcccggatttggagaacgtggaagtaatagtagtagatgatgcatcggattgcaaagtcggggaagccgaatgagcggcaagtacaacagtaacaacggcgaacaggggagagcggggagacaagtgaaagcatgtgtggagaagcaactatggatggcaggcaagcatgccacagggcagagccgatgctagatggatgatgatgcagggggttggcttaccgaaagcggcggtggagttttagaaaccttggagggggatgagcaaagtatgatgaggagacaagctgtgatgctatgagatgcagagagatgaggatggaatgagaccgacaaagacggggaatttagccaaatatatagacttcactgggtcctcatttttctgtactatgtagtaggtgagcaccacaattgcccccctccatcccctcttggcccatattcagaaagggttgctccatccacgtctgcgataggatgggtcaaatccggatagtacgaggacaccaggcaggtagtagcacaaggccctcatctgggttgacccagcaagtggcaggagggagggaggggaatagtttgggaccctccattcgccccgagttggagcaaggaactggaaccccaccagccaacgattgaagttgggcgatcgtccgcctcggcggcagtttcgcatcggcacggacgacgtttcggtcctgttttgtctccgcacgcgggacaactagtagcacatagactcacggatggtcggatggctctgggttaactttgtatagatcgataccgtcgaaagcttgaaacccaccctcgggcagttgacacattacggagtatgtattgaactagactagtagtagatgagccttaattggaaaatgcgtacagtgtatcatagcggtaaagcaacttaaaacaataccagaatactattgatcgtatatcccccaacttcagtcacagattgattgccatcccaacatgtattctaatgcacaataccctcgcgccagggggattttcccaaggccatgcggggttccagaaatcaaacggccattgggaaaggaaatacatgcttatgggctcgtgaggggaacccgagcctgggccgaaagttgcctgcatggccggaggtatgtcgggcgtagagtttctatggggaaacggaaaacctgccagcctgtcatcagcaagtgacagacaatgccaatggaccttctttttcctacgggtatcgttgagggaggatcttttagctcaattcagtcactcctctatccactttttcccatcaagcgtgtatccaccgatgttctgcggacagaattactgcttctgctgacttcttttcctgattgggatagctgtgacttccccctcgtgaggggtggtctctgtatcgccactatccctcatctggactagtggggatgctgcatgaggggtaacccctcaccccaaatgggaacagccaaacagacaaactaataggaaccggcctggccatccactcactccctgcgaaattaagtcgaattgctgctactgctgctactactactctactatccacccgagactcggaacaccaggtgccgttgatagcgtgatctatctatctcagtctagtcaggtccctcttatttgcccaaattgagcagcgagggggaaagaagaagggaaaatgacatgaggggacataagaatcacttctcaaaagctcgtctctccgcagataaacccgcccgtccgtccaccccccctaaaaaatgttccctccatttgaggacaactgaaattcaagcaccgagcgatttccgcgtttcagccggaccatgggtgccttttgcgcgaccgtgaacaatggcccattcaagccatcacaagagggtaaggaagacaaggacaaggcaggacagacccgcctgtcaaatgttgtcaagtgtcaggaatacatcatcttcaccaccttgggcgcctatgaggggaagcccggctccaccacctcctcactttgggacggcgcatcgcctttccggccacatcacgcgatggaacctcgttggccccaactttgaggggtaggattactgttgttgggtggtttagccatggcttccggactcacggagctcgactgatcgaaaaataggaaatgcgcgcctatcctcggcgggcgaacggcctcccagaattcttgttggaaaaactaccgacgcaaataacattcacacagtgaccggcttactgacttcacgggtcaggactgtcgatattacgcgatcgtcagtgtctcaggggagatggttactttattttcggtcttgttgccttctgtctaatatacatgcatgagtctatagttacatgcgtttttcccccgggaggatgattaatgtttttacaacaaccggagattcaagacactgtagggtcctgcgcgctaaaacaccacattcaccaacttgccccccttgacgacaatcacccgtctccgcttgtcccagtcgttcttcttccgcagccagaattgtccttcgtccgtctccaagatccgattgataatccagtcttgttcctccgtgaccgtgccgctagcttcgggcgcggtcgtgggggagagccgccgggggatcgtgatcgtaaatcgcaatttgccattgatctggacggcgaccacttggccaccgcgcgcagacagaatatcggcctcctcgggcttcagcagaggagttggccagggacagtcaaagatggcggggacattggtggatggcttccccgcagtcacgggaccattgaggatctcccaacattcggacgccagcgcgggcgcgatcggcgaaagcagccggagcagggaagaaatagataggtagaggacctgcggtgaactgggcgtcgacgacgacaacgagttggtcagcttggtcaggtcggagatgacagtattcagcccgtatggatttttctcaatacagctcgtgacagaggaaatggtgcggtgggtggcaagcacagcgtccgcatcactgtcgctcagatcctgtagagagctgggcaagccagtcgcgtggccggaggtggctttcaagtcggctggctgcagtgtaaacgagaacgaagccaggctctgctgcgcatcgttcaccaacttccagagtcgaccaaaccagcgctcaatgcccacgatcttcgtttcgtcccattccagcacctcgctgaccggagctgagaaaaggacatgggcccgagtagtatcggcaccgtatctcaacgcacatccggtcggatcgactccgttgtgcttgctcttggacatcttctcaaaggacacattgggcgtgatttgggtgcccttgatcagtggcttgtcggggctggaaagatccacttcggaggggtgcaggaatctccccgtagacggctccgaatacgtcctgccgtgcaccataccttgggagaggagagtcttgaatggttcaaacggcgtcgcaacgtttccagctcgagcgatttccgggaatagttcggactgggagaggaacttgtagatgaatcgggcatatagcaggtgcaaaattgcatgctcgacaccgccgatgtagacatccaccgggcgcgcagccgacggcgaaaacggctgttccttgttcttcgggtccaagaaacggaggaagtaccatgaagagtcgacaaaggtgtccatggtgtccgtatcccgcttagcaggcccgccacagctcggacatttcgtgttcacccactcatgggatgactcgagaggatttcctctcttgcccttcagccagtccccttcaatcttgggcagcttgactgggagctgatcatctggcacaggtacagggccgcaatcgccgcagtggataatcgggatgggagccccccagtagcgctgtcggctgatcaaccagtctctgagcctccattgttcgacaaagtcaccgcgtccgacctgcttcagatcggtgacgatctgcttcttggcctcgcgagagtgaagaccctcgtacttccagcacaaggagttcaaatatccctcttgcgtaaaagcctttgcatccgcggagggaacgatgctcgcgtcaccaccgtctgccccggcttcctcttggggtccaacgacaacgggtatggaatcggggttcacattatctctgaaaaatgcaaggtctctagcatcgtggcctgggactcccatcactgcgccctcaccgtagtcgctaaggacgtaaggcgccgcgaatacaggcaactgacgggcgacatgggggctctccttgtcaataacatgcagagggtgggaagcagtgacagtagacagtttgtagccagctttagagtcgggcggaagcgacgcggcagtatccagaaatctgcgcagttccggatccttcttcgccgcctccaggacaatgggatgatccagagaaagagcgaggtactcgactccgtaaagagtatctggtcgcgtggtgaagacatcgatatcgatgtctgtgccattattgccattgacggccacagggaacttgatcttggcaccctgcgatttcccaagccaattccgctgcatggaaagaacgcgctccggccagccgcccgccaaagagtcaagatccttcaggagcatctccttgaaatccgtgatacggaagaaccattgcttcaacttcagcttctcgaccttggctcccgagcgccaagagaagccattggcatcgacctgcaccaagagtgagccttttgaatcccgtgtgtaacccattccatagcacccacctgctcattagccagcactgtcttatcaaccgggtcataattgactagcgcttcagcctggtatgcgaggcccttctcatatagcataaggaaaatccgctgggtatgttcgtagaactccggtgcgcacgttgctagttcctgcgttcgacaaccaacatgtcagcaaagctggtaatcacatagcttgcacactcaacacacatacccgatcccaatcgaaagaggttgaaatacttcgtaattgctctttcatctttgttatattcgactcggtccattccgcggggtctatcccccgttcaatcgccgcattctccgccggcaagccaaacgcatcccaacccattggatgaaggacctcatgtccgcgcatccggtaaaacctagccagcacatcggaaatagtgtacacgcgcaggtgccccatgtgtaacgtcccggaagggtaggggaacatagataggatgtatgatttgggttttgcgtctccgtccgccgatgtcttggagggcttcttcaaggaatctgtttgccatctttcctgccacttcttatccaaggccaataaatcgagcttcttggagatcgaggttgcagatgcggtggttgtcgcatatcgagagggaacagcagtcggtcgtaaaatcggacgggatgcgcagttccatcgggctgggtgtgggagcgccgaccgtgtcgggctcaatcgaaaacgtagtagggattgcatgttggtcgtataatcattatgccgcgggggaggagtgtcgcgccattgactggcgtggattggtgggttggagagctggcagtggtggcatctccgtcaagatttcttgatcggatggctgaagtcatcggcggatcggcatcgcccgatagggaatagtgtcagggaacaagcaacattggaagacacatgagattgtcagacatcagttcaatcgaaagtaatatgctattcaaagccggttgtagcttttatatgatatttgcctcgcccgtgaatttaatagtagtatgtataaattttatgggatggctactagtagtgctactaggagcatctattagttactctatcctgcggaaatatataatcgcagttggcgacaaggaagtattcagactcataaaatgcctgaatataaatactataagtggtaagcagtccactagttcacacatgacagacagtagaaagacaataaccaaaacgcatcttatgagatcggtgacagtcccatactatccatagactggtcttgcacgacactgcgaatgtagcgtaagcttggattgaaactgcaagccgttggacccataaccagtgcgaatactccgatgtacactgctacccagcataaagctctggactcaattagaaaagaaactcgtaagtagctggttggactggagcaccatcataaaagccaaattattggctatgtacttccaacaacacctgttctagctatgatatcagaccacctcgcagagactcatgacgagaacagcaagaatgcgaccaataatgatggggtctctatcttctaagttcgagtgaccgcaggctcggcaggtacccgttgtgcctagagactttagtagtatctagaattctagattctcgcacctatccgttgggctcggagacttgccgtagtctagttggattctcgagctccgactcgccatccacccacagcatgcattggaaatcccgtccgcatcgccaagattggatctagatagagcttctcgatcccatctgcttctactcatctactggaccagaccctttctttagacgcgggatcttgaatctcatggcccacgtattcacgaacacccgttccacggaatcactccctgaagaatttaaggaggcggcctagacattcctattgagtagttacctacggggctccactcacggagtactccgtgcgaatttccagattgatcaggagcagaatctatttctgactcagtttatgaaggcccggttgctgggatcagccaccctcggcccggaaggtgctgcatacggaaactgacctccttttttctttctcttttccagagtgaatcatctcttattcggacggcggctcctatagttcttccatttaggggtaaatgcacaaaaaggagagctattgtaggggaaatgatcttatccttggtgttccatattgcggctgaaggacggatagacgctctagaaccttttcatcatcactctcgtatgcgtagggactaccgggctattcatgggactctaaccggcccttcatatagatgaccagcaagccacagcacgccggcaacttattccatacatggtggtaatatagaagctgtgaacttgattcccgacgcgttgatgacgctcgtgctgtgcagagctgtatgatccatatatggccaacagtgggggtaaacacgagctggagtaaacgacgaagcgtaccgaggcagagatagatataggggagcctgcatcgcctcgaaatgcgtagatcgatcggcaaagcagtctattttttgaccattctgtcggaattgctcatccgtcgtcattgatttgattgccgcacgcgtggaaagggagcagaagagtcattcgtgcctgaatgcccaggcaagaatcaaggggtcacgggcggcaagtaggaatctcgggatcggacggatttctcccctttttcttttccctccaccgaagctcccgcccggttcgaggatcgattgatttgaacccagagcttctgctggccgttcccgcttcgatctttggatccggtgggcggagcggagatgaatccccatctttttctgttcacgaaccatgggttcagggtttccattagtacttaggaatattccatccgtgtcagccatgtcttgagaccataaaatcgtcatctcttctttccttcccccccaccacccaccgtcacccttgggcaaggtgattaatattaagcaagtatggtagctcatctcgctaatccaaaccggcttgacagagactccacttgggatgagttggcaaccttagaaactgggttgatccttagctctctctgcctttcaggatttctctcaattggcccctatcattgggctatgccgatgacaaaaggaccaaaattcccctctccactgccaatgagaccttctggaatggccggcctaccatgacccctcagccacatcatctcagtggatctcgatcgccggttcctgtcgtcctcccccctcgaggtctcgcactccactggttggactggtcacaatcggaatggatgcctcgtgggaccgatgggaaggataccccaaatgtgacgagtagtacgtacctggattttggtaggtatctacaggtgggtgggaaagtaatcgtgcctgcggcacatgcgctgcaactattatgtacgacggcgagaccttgcatttcagccgtggggaattgcgtcccaaccaacctactacgtgctcgtctttcttgttcctgcatgctggaaggttaggggaggatgattgtgtctgtcgcctgtgggctgagtgaggatcaaaaagagcctgcctgctctccgggaataatcaatcactgcactcttttagtctgggtttgtcctaatttctcagcccgaggatattattagagcaacacaccatcaccaccggaacaaagcaccacagataactggatatcatgggagggctttaaatcagcataatttcgtattccgtggacagcattattatgaaggaacatattattattagagttgattggcgatcggggaccttctgaccctactcctatgtcttggaatatgacgaggaaaggcgttctggagcccaaagacagagcttacgagaactagttccagaccctcctggcggccatcccgcgatccccgtttaacttagccaggcgaattgggaggcgggcgtctttccccaatgcaggtggacaagcgacgagctgcaggaccattccttatccgccaatcgtgcggtttcaaagcggtgctctaaagcatgcagcctgcagcgcccctggatcgtccatcgtccattgactggccgttcacaccgccgctgcacaactggctggctggtttgagtgggagggccgaagtccggggctcctttaaatattactacgcccgggctcgtcgtttcaggtggaggatctctttgcttccactcgttgtgcctttctgtcgctcttttggaactggtttgcggtgcttttctggtctcgggttagacgctctttttctgttcttcgttcttttggttgcgaacctgtcccgccggtcgacatgactcgctaatctcaacctactggcattttttttctctatcggatccactcactctctttggcttcgtgtgccgttggacagcgttatccgctctcttcccgtcgttttgtgtcgaggcattctttattgcatcataaaattctagacaagcaaacaatcactatcaccacaacaaacatcaactgggcactgttactcttctctcccccccccggttcaccctcggcggccattgctcgccctgagacgtgcccctcggtggtggtccttgttgcggtgctgttgctattactctcatttcccaaaccgagcagtcgtcgattatcattctcatcgttttgaatctggtgttcttctagatctcttccccctcccctcctccacttcccccgaagtgccttatagagcgggggtgctctttgcttatccgcttttcgtgatctttttgtttttgttctctcaggaccttctggggaactcccatccttttaacaagtcttaatcttggtgtctactgactgataatgaactaataatcccaacatgcgctcagctgcaccgacctcgaactctcccaaacggagagctcttcatgagcgcaccccttcccatacgaatgagaactccccaccttcatccttgcgagccgtcagcgaaaaatacaacgatcagcaggaacccgacgtgtacacatccacgccttacccgacaaagccggagcagatccttttaccgcgtcctgggaaaggccaagatttcattccggactcccggttccatgtcgacgaagcgccggatcactatcacgggaatacctccacggaactcagccacctcgccgatagtagtttgattgaccagtcggttagcgatccctgggacttgtcttcaacattcgatgccgccaacaccccatcgcaggtctgggaagacgatccgtcctccagcaagtcttcctttccggagcctgtccttcacgaccccaagccgaccgatcagaaatcggatcaaggttccgtcgccgcgtattcggatgaggagccaaacagcctgccaagagccgtcccaactattaaaactgtcgtatcgcagacgccgtcacgggttccttcgggcccggagactcttgcttcgagcaactccagccccaatgtagtgccaattgggccgccttccagtccgaatttcgtcgcgctcgacagctcaagtctgaacttcgttcctctgggtgcatcctcgaattcggcctcgatcacccgctctaattccctgtcctcgttaaactccctgggaacggtgatccggtatattggagccgctcagtggacgcatggctcgtcttcagaacactccagctcgcgctcgcgttcgcagtctgtccgctcgaaccctccataccaggtgccttcagtgcgatctaattcaacacgagcacgggaaaggagtcactctcgctctgtcacctcgtcgtcgcgtagcgggccaccgtcagacattcaagccattgttgacagcggcgtattcatccaatacccgaccatccaggcgccatcttcgtcaagctccagagttgacgtgtcacattcggaagaagatgcatcggatcagaacccacaagaacccaccacggattattcttcggagcgtttcagaactcacctgtcaaccgttccttccatgtggtccgccgaatgtgactcgagaagcatttctccggccgctgattctattgataacagccagatggatcctaaacggccttccgcggcgctggtccgtcaacgccccacgtcgtcttcgatgtggttagtgagcgattcggacggtgatgagcggatggacaatctttcgagcttgccagcgcgtcccacaaacccggcagttccctgcagtgtttcgtcggagtcaagacagagcagcatgcggagcaacatgcgacctcccaccagcggaagcttttcattccactttttgccaaattgggccaagatgtactatggcgccggcgagcaagctgaagattcggtcttgtctggcgcggaacccgatcggccaccgtctgcgcgcgcctcaacctcccacacaaatgttctcaaccgtttaccgaccgctaccagccggacgaggacgaggacgtttggcagcgaaatgcgagaaactctgcggtggaaacccgacccgcgtgatccacggaaccactgggtaagggaacccgaatcgcagagccgggaaccatcccgccatcgacttcgacacagctggtcccctcatctgtttcccgaccggcgcgcggttaatccaaggagaggtacctggggtgcaccgtcgctggattcaagaacggaaccactacttggccgaagaaacatccaagtgtggtcgttctgtgttggttttgtgtttcctctcggtatggccccatcgtgctccatgatagtcgcctgaacatgtcaactgactgtgtacactagcctggctaattgcgtcattcctccccttaccgacgaaaccggatgctattccggaggacgacgtcgagtcacagctcgaaatgacgcttagaatgcgcttgttcgatctggagacaagacgacatgaaaacgctcggtggtggagaaatctcaaccgttggatgaacccattggggttggtgattattaccattgtggtatgttatcctgttcactttatcttgggtattcaatgctcatcctttcgcagatcaccttggctgttgtgggcaccacagtgggcttctagacgggtacatctggcttctatagcgtcagcatgcccgcaactagctatgctcttctatccacgaccccctcgattattgcttgtactaccattacccccccttttcacgccctctcgccggctatgccggcgcctgttctcgattggatcgatctttgctttcaccgttcggagtcgattcctccatttataccccccttcttcttttgcatgctacctgccccccacccatacccttgcgcgcttgatattgccgcatttctattcccctgcggctgcttggtttgtttacctttctcaaaacactcgacacgattggacgacgtaatgcttctaatgttcttttcttttgtgccttatattccacctggtgttttggactctgtttcagcccgcccttggaccattatttggtgaacaaacaatggggtggttcaatctgggagcgtgaggcgacggatttaattaagggttcacgacattgcatggatatatgtcattttcctttttactttttttgttttcctattttcctatatcttcccttctcccccatgtacttatggatacatgttttacttatgacaccgtgaccaacattatcacagtatatatacaagtggtcgtcgcgctctgcgtggctcctcttgaccaaaaatagacaatatatgatattatactcctcgaatactctgtagactcattgttaattggtatgattatagacaattccgtcagactgaagagaacaggaagttgctgaaaatactcgtctggcttcaactaagcaaaagaaagtaagacttgctcattacgcttattgtcggagacttcgtagcatataagtatgaacgaattgaaagtgtacgtcagcgccggaaagcatacataatagaagaataagaatcataaggatgccactcatcccaaaggagcaccaacaacgagacaagtatgcgcagccgcttcggagcagtaaaaagtctaatatacattctatcgtcaaccccatcaatcgttctcattcacacgtgtcgaattagttggctctaagccagactggtagcaggtcctgagacctggagtcttaagacccctttttttttttttttttttggatttgggtcacatgggaagtcacaggatccagatgatcatgtgagcttgcggccaatcttgctttccacgactgctttcagctcttctccagtcggcatggtaacggcactgccgcgtctgcgcctggcttcaatttcaccccggatctcctgcacggcctcatcaaaggcctgaacagcgtcacttggaagacctagtgttggctgttgcagggtgtcggagctggttgagcgtgtaacatgaggccggttgcgggccttgagcttcttgatgaggatgcccttggcggggctggcaaagaaggcaatgctgaggaggttgccgacgatcccgtagaagtagacgctctgccaaacgccgatggacttgctaaatccgaggaagatgaagggcatcaccgtgaaggacagggtgacttgagtcacgaaccagctcataatgtcatagtagcgcttgtagggagtcggcttgctcccgtccggagtgaggaagaacgggcgtacataacgacggaagtctgcgcattgtcagtacgggaaatcaatgcacgggtgggttaaccaggtgaactcactcttggctcccgtctggatgaacgatccaaggatgaatgtcagatagtatcccgggtagaaaccatgccagaaagcgctggtcgtaaacgtggccaagctggcgcggaagcccggcttctttcccctgggggtgacgcgcaaatagacatagtttcgcagccaatggttggtgttcttgttccagctgcccagatatccgtgggagttttgcgcggtctcaagactccagggatcgatattctccaaccggttccagaagaccttgccggacttgggatcgaagccattgtatcccatgccagacaggatacaagcaccttccgtcagggaccagacgccgtagtacttgaggcgtgcggttagcccgaccatgtgcatgatccagacccgtcgagggaaggagtagcccatgtatctgggactcaggatggtttcttgattgtagtaagaccccagctgtaggaatgccaggatccatgccagtccaaccagggccttcttcgtggcaggagttccactgcgagggatcttgcgcttcttacgggtcgggggcaccttcgacgggtcggtacccggggggacttcgaaaagagtagtgtcgagccagcgacggtagtcgacgtattcaaaggacggaccaccgaaaagagccgggaagaatagcacgtagcccatgtagtccaggatgctcggaaaatgcgtaatcgcggcatatttttgaggatctgagagctggttttggggaagtcgaccatcatgaacgttccaacagaaagacgtgagcttcatgaccaggaccatctgggcaccagtgatatcaatcgcttgaggatcgttgacgatctggcggtagatgtggctgatggacatgtggcccatcaagaagatgaagccgatccagggcatcaacgatccatcaatgtagtaggcgatcagataggtaccggcggcgctatagaacaaagtgcgaaggccatcccataggtcgaaaaggccaacgagatagaacaaggaaacggcaatgatgaaggcattcttcttccagggttgagcgtcggggattctcttcaacagaccggcgagggggtaggagaggaggaatgacgcaatgagcttcactgttcagcggtgagggactgattcgggggacgaagaagggccaggacggggagggagaggcatacgctcatcaatcgaagctccagtcgcattggctggatactcaaagactagaaagagagccttttagcatgatcttcacgcaggaaagaggggcgcgcattctcaagtgctgcgacggaaggttcacaacatactttgattgataaatggtaacatggtggatgcaaatcgccgcaaagaacgggcagtaacaagaaaaggaaaaagtttaagtcaccaaggccgatacttaactgtgtcggcacgacatcgagcccagagatgaaatggttgaagggctggggagaagcaaaggggaaaacaaaaaaaataagggcgggcgggaacgaagaaatgaaacggtaactatctcaacggtctgatatcacatggcagctctccgatcatctgcgtgtctcaaccaatccacccgccctccaagtcaactcaccctcctctgatctaccacattttggatgctgatgtatcatctcccgtttccgatcttgagagtctagaatcatttccacggatctgctagaccaaccttcttcgttttcctcctcttgcccctctctccacacctcaccccctcattcaacatggatgtcgtcgcggcggtgtcgggttacatctccaagatggtcaccgcgggggacccttcgccgacaggtggttccagctcttcatcggccaagatgaagatattgcttctcgacagtgagacagtgggacttgcgattctctcattgatccctgtggaagctgtgcgctaatccaacggctccaggtacccattgtgtccaccgccatcacccagtccgctttgttgaaccatgaagtctacctcatcgatcgcctcgataatgccgctcgcgaacgtatgcgacatctccgctgcctttgtttcgtgcgcccttcccccacctccgttcaattcctgatcgacgagctccgcgagcccaagtacggagaatactacatctacctcaccaatattattcgcaaatcctccctcgaacgtctcgccgaagcggattcccacgaggtagttcgcgtggtgcaggaacactttgccgacttccttgtgatcaatccggatctctgttccctgaatttgggcttcccacagcagcgcttgtggagccagtcgccagatctgtggaatgcggatgccttacaaagagcaacggagggggtcattgccatgttgttggcgctgaagaagaatccgctgatccgttacgaaaagaacagtctgctagcgaagaagttggccacagaggtccgctatcaagtgacgcaggaagagcagctcttcaatttccgcaagaccgatacacccccgatcctgttgattttggaccgtagagacgaccccatcactccgctactgacccagtggacctaccaagcgatggtgcatgagttgatgggcattcacaatgggcgcgtggacctccgggacgtaccggagattcgaccggaattgcgtgaaatcgtcctttcccaggatcaagatccgttcttcaagaagaatatgtaccagaactttggtgatctaggccagaacatcaaggagtatgttgagcagtaccaggtcaaaacgcaaaacacgatgaacatcgagtcgattgcggacatgaagcgcttcgtggaggactatcccgagtttcgtaaactatcgggcaatgtgagtaaacatgtcacactagtgggggagctgagtcggcgcgtgggtgaggatgacctgctcgacgtcagtgagttggagcagagcttggcttgcaatgacaaccacgccaatgacctcaaggtacgtggactcttttttctctctccgggacggagcttgcgccagaccagttgttgacaccatctcgtgcagaacctacaacgaatcattcaactacctagcgttcctgcagagaacaagttgcgcttggttgctctgtacgccatccgctacgagaagcaaccgaacaatgcactcccgatcctgctcgatctcctcgtcaccgccggcaacgtcccatcatacaaggtcaacattatccctaaactcctcgcctaccaccactccttacaagccccgccggtcgcaggcggcttttctgacctcttcgaatccacatccctcttctccggtgcccgagaccggttcaagggtctgaaaggcgtcgaaaacgtctacacccagcactcgcctcgcctggaagccactctccaaaatctgattaaaggacgcctgaaggagctgcaatacccgtttctcgaaggcgggggccatacacgagacaagccccaagatatcatcattttcatggtgggcggggcgacgtatgaggaagcgaaaatggtcgcccaagtcaatgccagctcacctggagtaagagtcgtcttaggaggcacctccattcacaatagcacaagcttccttgaggaagtcgatgatgccgtgagcggctggcctgagcccgccccctcgtccgccgctggtcggcttcagagggcagtcggacattaacctctgctttgcttctttgcctctgtgtatctgtagcttcttattataatatatcctgaaatcttagctgttagtcactttcatgtctgtctcatgagtttgttccgcagattgttatcattaatctgcaaacacaggaaatgaggccacctctgccttgaggtatttgaacagagtatagttatgcttcgtgtatggtatcccaagccaatccggccaagctgcgtgcatagctagttcattctattaacgtggcacaatacacaacagtaacgacgctctatcctgtagatacatacccgctatttaacagggtgttcttcgcgtaaatagatatgcgaaaggagaggagagaaaaaaaagaaaaaaaaaaaaaaaaaaaaaagaaaaaagaaagaaaaaaataaagtaggaaagaaagaaaggatgagaggcgcacaactaactccctacatgatacatgattcatccgttgtcgtatatacatttgacagaaagaaggtggtcggaataaggaaagagaatacagaacaagaaaaacaacatttgaaatgtacatatacacaaagcgcgctctctctctctatgtctgcatttacgtcgtgattaaaatagtgtttcctgtggcggagaatgcaacgaatatagacagaaagaaaaagataatgcttgctgaaatgacaagaacctccccattccctcttctctcacaccactaaatccttatgagaagcgtttcagtcatgagcattcataatgcaagtctccttagcgtgccatattcgtcgtttcttggccacatctgccccaaaagtatccgtgatgataccatcgtcatcatggaaagccgcctgggcctgtgcgggtttggaagtctcggactcggactcggtcgccggcttcagcaaccgtaattcctcgacagttgcaccgaattcatactctcctcggcagagaacggtgacgccaacagtcgccgtggtgctttcgccgctatgcaggatggggaggacttgttggagcatcccggtccatgcgaggcgtcgcgacagatctaatgctatgttgctaggttggtgacggaggctgggttgaaggcggagtagagggtggacgggccgcgaggaacgattgaggacggtgacggtgaggttgagcatgtcgtcggttcggacatcgtattttgagcgccctgtttgtaccacgctctttgtgtcactgggaaaagcgggttcgagggaatatgtcacaccaacgtcttctagccggaagaagtcaaccatgcgcgcgttcaagcgaaggttgcgcagatcgactattccttcacggatgcctgtcttctctttccagaacccgcaaactctctcgagaatctcttcccggtaccagaatgccttgcgtgtcgctgcctcggcttcgaaagtgagcttgttggcacttacgacaaactgccgcttgactccggtgttaaggattggaatagatgcatgtgggttgtcgagataggctcgagggaggacaagcacaaatcgtgacatctggcctggctggagctctccgtgaacagtgtatttgccctctccatcctggggcggttctggaggccatttcatgtctgatttcactgccttctcgccgacatgcaaggtgaccgacaaggcattaggccaggcattgcgaagatcgaggagaagaatacagtgatcagggccgtatccaccccgggcgaggtgggaaagcacaggtgagaacggatcgccatccgcggatgggggtagaacattggtgctgatttggtcaggttctgcttctgcctcagggttgttccaccatgcgaagtcgctgctgagtggcagaatgtcacagcgagcgacctctatacttgcatttaccgtggcagtcagtgggacgaacaactggcgggtatagaacacgtcaggtaagccctcctgcgaggatccaatacacgagtagtcgatctgcacggtggtgtcctgtagacctggttttccaacaacatcgatggtgaatgtggcgctttggcctgctggaatggagtggtcctcaggatttaaaccttgtcggcgccaccgcaacgctggcctggttaagttcagctccagctcgtaaatttcgacgggtagtaaatccttattgctcagggccgactgcacttgtcttgttgtcgaatcctggaaggtaaagaggatgaaatcaagaggacatggcgacgtgttccgtagtgtgatggtgaaggagctcaactcaccctccagcaccatcagcgcggactgtgacagggacaatgactcaatcaccaatgagggctgttggccaatgaccttgacctcgcacaccgatgtgtcagggcctttcttgggaagttgtttgccatttcttgaggttgttgagctccacgaaagtgggcgctccacagaaggcctcttggccgcaagtccagtgcgcttgaatttccattcggcttcgggcttccagggactctggaatatcggaaacctgcgctctctgcagtgtcggaccttcactatgcagccagtaaccttgagcgccccctctccagtggctttgccatagactgtgatgtcttgcaagcatagcggaggaatcaggatccattcggccacggcttctagaggcacaccgtcgctgtcgagagtgagtctttcgatctccaaatcaaactcataagggttctgaagtgtgacttggaatgccgcgtattcaccagcaaccatcaaggattcagcagccttattacttgctttagagaaaggattatataagaaaggatcctttgcggacttttcgcgatcagctgtaacggcatccaaatcaggctttgagcggcgaacgggtcgtctgggatctggaagagatagcaattgaacaccacggatgagaaaatcatcccagtactctgcctcaagccccgaggcgcccagtttattggctgcgccgacagtccgtttgatgttattcaaaagtctgatctgttcgtcgcgaggtaggtatggtggctggtagttagatccgagcatcaagtctcctctgatggtctgcagaagttctactgtgaaacgaaggacgccgataaaatcagggagcgcttcgcaagaactaatgcacgctttgagaacatcaatcttcaggttgagatcaccgtagccatctagaacggcgtgcctaaaagcccgttcaacaatagcagtgatcgaatcatagtcgggcaaggcatcttggccgctcgcagtggaagatcgtctcttctcccattcgtagaatgaagatggttggacaccatagatatcacctatagtagcaaggagcgagcgcatgctctcctccatgttccctggccccagatcaagggcattgatatcaaatgccgtgtcgctgagagatgccaggccagcagcaggatgaacccccacttctgctgcgccaatcttccgggcctggacaagcgtcggaaccattatggataaaagctctcttaggataaaggccttcttccgcggtaggtcaaggacattcaggacagagactacgccaacgataataggtatggcgtccgttgcgggcaggtctgagccaggagaaagaggcagggcgcggaaaaggaaattaccaatgtcggattttcgaaggatgttgagaccacgaggccgttctggtcggtgcaaaggtggaagggactcattcataactatatgcttcagggcaacgtcatccaaggcaccgtcgcgaatacgagccgccgctaataaccttgccaaacgaataactgtttcggagtaaacaagttgaggcagaggttcatccgtaatgttggcggcacggttatagagattcagaatattgttcgcaaggtcaggcaataggttggagaggttctgaagcgagataatacggttcccaggagatgacagactcgtgtcaaggctactgctatatgacagctttgaggatttgtcggcgacagggtagcaaacgggagggatctgccaccagttagtcatatccaaccgaccttgtgcaccagatgatacgtacctgaaagtccattccagcccacgcgaccattaatagacaaagaagaatggactcaagcgctttcgcatgccatacgtagtcactgcttgctctagcactagacgcagcttcaacgagttctttcaaagcatctggccatcttccggctagaaggaacaggttcccaacaacaacacctgagcgacccttgatgcgattcttggtccgatcagtcgcgctcatgccgctcacagatagacggtcccggctatgctccttagacgatggcagcgaatgtattttgcccagtgagttggaacgattggccaattgtatcgatcgggtgatctcatcaaaggttgtaggagtctcatggtcgctaggagcaggcgatccctgtttggagctcaagggagattcgggtgcgccatttgggttggatgggagatgtgtaggcagggtcatccggtgaaatagcctatctgtcggtcgcgggcggatgtcagggccgcgatggggcccccaggaagacgccttcggtgactcgatggaaggtatactttgaatagtcttcgcaaactcgtctagctccgaaagcaggagagatgtaatatcacacaggacagttttcattgtagtggccttcgacgcctgaggtcgtgggatccagaggacgtcccctgggccgtttgtgagcttattcactccttcatagtcgaagataaggagctgatgtactagcgctctcggattgctctccttgagtgtttcgagttcctgccgaagttgctccaactcgcccggtgtgggcggttgatctgccgcagatgccggttcactcttcttcacattttcgccaagttctgcaccgtccgcgattgcgataatgactagaggctctcggtatatctcgaaagggaagaggtctaagtgagatgttggaggcacggagtaggacaagtcgtaaagtatcatgccagtagggaaggcgagcggggagaacatgtctatgtcgagaatcagtcaatcactgtacccattatgtcggaaacaagtctctcctgctgcggacatggggtactgagtgctagcatacttcgattgggtcgcgcatcaggactgatatcgcccaagcggacaacattttcggcttgaagccttgcggcaaagctcaagaatctcgagcgctttatcttgccaatgggtagcagcagtgcccgtaagcgcacgggcgcaataggggagagggggtcgacacccatcgtatcatctgcgactgaacggagggggagcagtcggcgagttgctcagaactgcttccaaaagggcgggcaagcttccggaggtcatacgaagcgctaacacaagcaacagacgtagtagtgaacacgggcgaatgagcaatgcacggattccactcgcgactctcgttaaacttcgataaacagagccgtgacctctggtcacctggaccacgtagagagaaacaactcccacaagaagatctaaaagcaaagaacgacagaaagtagcaacgcggagtggatagatcgcggcatcgggcgtgcctgtcgaccgccgtatccccaagtaaacccaaggaaaccccccgatgtcacgggggggccctgatgacataagcgctgcatatctgataagcccgataactttaactccgcgctgtctccggccagtcactcgccatcgcctctgcctccgttattctctcgcgctttctttctcgctcttctctcatctcctcgtgctctccctctcctaggcagacctatctcctaacaccctgttttttttgttgtagcttttggtcttctgtcttggtttgtgagcgataatttctatctatagaccactctgtcgtctaggttacagtgttatcaaacaccgccgcctgttgaccgaccacatcaccaaaagatccatgtcttagattatcaaccactagcctgtttttcacggagtatttggggagtgagcgtatagaagcattttcttcgagcagaatcatggcacagaagatcgattttaacgccctcagggcgcgtacgatgggatcagggaacgatgaggaggcggtcacagttgacacacggggtctgatctccaaagtccttgcgcgctactctgggaaatggtacgtctacttccgtggcatctgaaatcatagcggcgtttactaaagtgggatacataggaccgttttacgagagatgatacaaaatgcggccgatgctaatgccacgaaagtaacgattaagtttgagacgctaccatctacgacggttccgctacctccagccgcagacgagagcaccttaatcaaacacacgatatctcatcacactctcaaacgtctgttgatatcaaataatggccttccgttcagtgagaaggattgggcaaggttaaagcgcattgctgatggcaacccggatgagactaaaatcggtgcattcggtgtcggcttttacagtgtattcgatgactgcgaagaacccttcgtgtcatctggaaaagaggccatggccttttattggaaaggcaacgctctctttactcgtcgattacagctggacgaagacgcaaatcccgagactacatttgttctagattaccgcaatgatacgtcaccagtcccctcgttgatgcaactatgtcagttcctgtccagcagtcttacattcgtaagccttgaaggtatagaactatggttggacgactggaatctcttgcgactcacgaagaagactgccccaagcgtcaatctaagcatccctagggacatcgaaactaaaacgccgcagggcctgatgaaaattcagaatgtcacccgagaggttgctcaggttgatgcttcgtggatgcgcgtcgttgagtggaaccctaacgccagcatcttccgggaggggctcagagataccacgggttctttgcgtaccttcttctccagactcacaggccagagtgcccccgaaaagccagtgaagccggaacaacaggatagctccactgacactggagagatgaccaagaccttgactgcctcggtctttctacatatcaacaccgccagcctccaagcttctgtcagtcagtctttgagcagcgaacttgaacgagctacacgaaaacctccccctaagcgatccaccatcgctatcttgaccccctcatatgatacaaccctggcttctggtgcctccggcctacagtcagaggtcctctcctctatccttccttctaaggctggcagggtcttcataggttttcccacccatcaaacaacaggccttaatgcgcatatctctgctccttccgtcattcctacagtggagcgggaaagtattgatctcaatactcgctacatcagcaagtggaatctcgaaatgctgagggctgcaggaattgtctgtcggatcgcatggactgccgagatggcgtccatcaaagctaggatatattctgggaaggaatcctcgaaatccatgaaggtgcggaaggatgatatagcgggtgttcttccagaagccatccacactgcaaaccagttcgtattccgtgaatcgacgccatcgtcacttcttgggcaaaccatcgaagacgcattctggacgtgtaacaaaagcgcatccattgaggtcctttcaacatgcggtattattcagagccatcaggcacgtcttgccccgaaggacctcagcttcatggattctataccagttctgcccgatgagtttgtatcgggtgcaagggatttcgtcaagaaactgacggatttcggcctggttactgatattacggtctccgacatcaaacgagaacttgagaccagcacactacggtccggccaggttattgaattccttgcctggttaggtcgaagggctgcctcgggccagcttgatccatactctatacaaagcctgctgagtgtagcagttgcaaatgaagaagatgagagcagcccccagaatagactggttgtttttggcagcatcgacagttatctaagtcctcaaaagatacccgtcaatctgcctgttccacccactgtggcgcctttcaaatttactaagtctcttgggaagcaggagttggaggcttttggctggacggaacttcagatagttccgtgggtgcgttggctagtctgcaattctgctaatcggaatctcttgcccttggatcaggatatcacacagagtccctcattctctgcgcaggtcttgccggttctttcgaagcaatgggagtatctgagccagacagcgaagcaatcagtgatcaaccagttacagtcccatactgtgatccctactaaactagggatgaaactgcctgccgagacctacttctcttctgtccggttgtttgatgaccttcccgtcatacatggcctaaatggagttaaagagaaattcctggcagcgctcggcgttcgtaagacagtcgagctcggtgtcatcttcgagcgtcttctcgatactacggaagcatccgatggccctaacaacactcagagaaaatggagtcatgtcgacttaatacgatatctagcttccgtgcgcgatgatattcctgcgaatgatatcaaacgactcaaaaacaccagcttatgcaccgccgaaccgatcgacggcagtgggaatggtgatcttaaagcagctaatcgcaagcgctacaagatttttgagctgttcgagccaaaggactcgctcagagctctggggttgcctatcattgaatggccaggtcggtatcagcccagcagcaacgaaggaaagtttttgtctatgttaggactcaggagttttccgtcagcttctgagcttattcaaatcatggctaaggcggccgtggatggtaactgggttctccatacaaaagcgatgtcgtactatattgccgagtttcatacaagtggctatgcgatgtttgactgcagtacagtgaatgtcccgttcttgcccgttgaaggatcgcaggggttgactgttccgagtaaatgtttcactgacgatggtgcgaccttgtttggcttcgcaatccttcgcatggacctgcatccacatgcatccaagtttggggttaaacaacacccggctctgagcgaatgcatcgattgccttatacgtcagccaccgtccacgaagcgtgacgcaagggtcatattcaagtacctagctgggcgggtgtctgaactgagtgggcgggatatagatcgtgttggcagtgcgcaggtagtccccgtctcgactatacaggatgagatggaaaagaaggttgtgcgtcgcgtagcacccagactttgttatcttggtgatggcgaggattacaaagatatcttcgacttcgttgactttggtcaagaggcgaacctcttcctcatggccgtcggatccaaacgtgagcccaccaaggtggaaattgcacgcatgctcgtaaaggaaccggctaggatatcagcctcttttcaaagtgctgataaatatctcaagttactgaggacactttctgagcatgtctcgaccttgaagagggatcgcgaactttttcaagaaatgaggaggtcggcttttttgctcgcaagcagggatattacttccctggcacaggagcaagccgccaaagatgaccacgtgtctgacgatgaggatgaagatcaaagcattaaggaatggactctgacggttgcgaaggatgcggtcgtggtagacgatttccagagcttcaatcttttcaaggaacatatactagcggcacctcaggaagaattgctggagaacttctatcagtctctgggggctttaccgttgagtggccttgtcgaagagcgtgctcactggggcgctgtagctgccgatcaacgtccagccgccaagctgcaaaagctgatcaatgaacgctcgcggctgttcttacatgaccagtctcctgatctgatccggcatgatgtgcggtggctagagaagcatttgcaagttcaggtagtgcattccatctctctaactcgctctcttaagggtcgtcggatatcccacacccaaaagcgaagcgcaatcatcactcaacagggaagagactggctcttgtggatctgcccgggcaagtatgacctctacgaaattagccaggctctggtccacctaatccttgttcggccgaagctccattcaacccttaccttggagatgctgctgaagactgatctgctggagctcaaggctcgcgggtacaatgtggagcgcattctcaaacaaaaagcacacgaggctaggatggcagaggataggcggcagaagcagctggaggaagagcgtcagcgtctgcaagagagagaagctgcgtgggctcaggaacaagcccagatacaagcacaacctcattcagcgcaagacgagcgagagcagttaatgccgggagatttccccgactcgccgtctggcaagaacagcacccgtgacgttcagccggacggacctgaccaatcccaagatcgacggccacgcgggttcttcgccaacctctccaagcgttttgggctcgagggcaaccggtcgccctggaatgccctcaacggagagcaatctcagccctcccgtcctgaatcctcagagactgccacccctcccccgccttactctgccgaagatcctcagaagactcgctcggaagctcctgtcacggttaattcaccccatcgactccagtcggagctgctctccgccatccaggcgtgtcggcctcatggatcttctgatgtttatagccggcctgagacgaaccagatcaccgagaagaagtcctactgtgatgaaaagcccagtcatgatttagagtttgtcgcgacgcttgcatgtgggattcacgtattatttgtgaagaacctcccggaccgcagtcaattcttggccaagaatagcgtgggcattaatgtctttgcttcaatgctaatggattgtgccggggtattctcgctccggtcagacatcctcagtatcttctatgatcccgggggcaaaacaatcgcctttaaccgggccggcagtgtattctgcaattacttttacttccaacagcttcacgagaagcagctgcttgcaaacccgactgccgaccgagcggatgcacttgtatactggtgggtgatcctatgccacgaactggcccacaacctggtggaggaccatagctctgcccacagttactatacgtaagtttgctcccgcaatagctccgtttcttttcattggtcttgataacatggctgacaatgtttctagcgaaagctttgtcgcgcaatatttccccaagatagcagccaagctcgcgagcgcaggtagagctgctccagaatcgaggggctaatccagcaatgtgtttaggacttagataggagttattgtatatcaacctaacacagacggccaggtgccgacatgtacatattacgagatagctagacgctcaaatatttgcttagatccccatcagtttgtagtgtccagacccattccatccgggctatagctagtgatgcaaaccggacaaacactggtatcacctccgcggagagatgcgcgggcctacaatcttcatgatctatccagaggtctcaattcagctgcgtcgtctctactgcagcaatttctggccatcatccgagggagtaacacgtttcagacggcgacctcatggcgggcacacctgacgcctcgatggaggaaatcctctggcggtccccgccccacgtccaaatgatgggaggatatctccactccaacaacagtatgagatttggatcctataacaacagaagcagccaactaacactgttaatgtataaacagttcttttctacttcgcagagtcaccattttttgacccgacgtcgaataacgcctcactggccatccaagcgaactacaatgaagctttccggcactttgtggagacgcgcgaggccttcgagggccgcctgaagactatgcagggcttggaattcgtggtttcatatgatcccattcaggcagcagcacaacctgatggtcgatttgcacacgagccgtcgaacatttgggtgattcgcaagcagaaccggcgcaagaggaccggcctggacgatgaggtggcggttttatcaacgtactttatcgtgggagactgcatctacatggccccgtcggttgcgagtgtagtgggaaaccgcatcgtacgtcacatcggatcttgttttgcttccagtatatcctataatgctgatgctaaccccgacttcttgcgcagctgtccgcagttacgtctctcaccagcttgctaaagacagcatctacactcccaaccttcaccccgtcccatggccatacttacatgccgcctgcactcaagcaagcagacgcaagtcaacctggcacccaatcgcagcagagcaaggaaaacacaccactgccagacgccgatgcagctggcaaagcctcactcgttggatcttcacagatggtcggcgctggttctagcctgcaagacacgcggacactcgcagagtcattcaatctgctccgaaggtatggggatgagttcatggacgaacatccgttggtgggagagcccggatcattcatcctatcccgagtcaatgacacagaccgaacctcggcggcgaaaccgccagccactgccgcgaaggttggaacgccgcaggtccgggttgatacaccgggaaaggtatcagagaagggggcgacgccatcggggtccgaagagaataaaatgcggaagaagaaaactaaggttggcagttgaagtgggaggacagaataatgataccctaatgatcatgagagcaggattctctcatcccaattccattctagacctggatagctagatctcttattcaatctacaattgaatttggctcttaccatcctctcctttttaccggcttatcaccatagaaccctttctgtaacagaagcaaggacagcagagcaaccccgcacggctacccaatccaatcccagtgacagtcaagtatctctgagtcattatcacatcttcatcgcaaactctcatattattcgcctgctataaaatcaaactgagatgtccttcccatcatgattactacctccacgtttaccctcgaagtgtcttgtgcagtctgtccgcattcggatccagaaccgcagcttcaagaaatcggttacatcactgcaccgacatcttagaccattggactcggccaaaacccccatcgaacttctcctctccattctgagagcgacaagagcgagtctgtatcttcctcatctgtagcaagtagtttcaataagttcaacggcatcatgggcttcgagaatgggactaagcccgcggtggtctgcgtattgtaagtcaccagcatatcatatcatatcatctccagccctcaccccgcatactcaatcctttcgccaccaaccacgaaatttataacgaaactcccaaactaaccaacccattacagctgcggctccgtctccggcacaaaccctcgccatatggaagccgcgcgccagctggcgcacgaattccacaagaacaacatccaccttgtgtacggcggcggcacagcaggcctaatgggcacaatagcccgcgagctggtcaaactatccggcccgcaggccgtgcacggcgtgatcccccgcgcattagtaaaggtagaaccgggatacgacaatgcaacggaacatcccacagacacagattcaactacaggaatccagcaagcgcggtccggtaaggacgcggaacgaatcatcccagccgctactaccaatggaactactacaaaggcgaaggaatctatgtttaaggaatccgagtacgggacgaccacgattgtggcggatatgcatgcgcgaaagcggcttatggcgacgaaggtgcaggagggagggcctgggtctgggtttgtggcgttggcgggggggttcgggacgattgaggaggtgatggagatgacgacgtggaatcagttgggtattcatggggctggggtggtggtggttaatgtggatgggtattgggatggggtgttggcgtgggtgaggaaggcggtgcaggaggggtacattggtgaggagaatgggaggatcttggtggaggtgaatgatattaaggatgtttggccgcggttgaaagggtatagggttagtaatgggaggatgaggttgaattggggggaagaataagcgatatctagtaagttagtaggacggttagttgtagatgtgggaaagccgagtgtggttatatatatataatggtatcaggtgtgtgaaacgtgatattattccggaatcgtgactaccaaatcaatgatgtatctgttgcatcttgcttctcctatgaatcaacctccatcgtctcctcatctttcgtctcgcccgcatccgcctgctccagtgcctccagcagcggcaccagctgctgcccctcgtacagcttgaagctttcgatcttccccggggcaccttcgcccgcaagccccaccacacccacggatgtgttgtccaccgtcagctccttgtcctgagacagggactccttgagtgcccgcaggccgtgcgtgatgagctcatcgcgcgacgaggcctccagcttgtccagattccgctccaggtaggtccgagccatctgggagcgggctccgatggcgcatgccaccatctcatgggtcataccggagggttgaaattcgaaaaggtgcgggccggagtcgtcgacaccggcgacaagcagaccgacaccgtaggggcgcttgccgtaatgttgagtgttcgtttgggcgcggtcgccgatctgactgacaatgcggtcgacagggagcggacggccgtaggtcatgcgggagctgagcgactgctgcttcatgaagttggagagcacccgagcgtccgatgccagaccggcgatggcgatgcccatgtgggagtcgacttcgatgatcttcttctggtacgaggacagctcttcggcattacgctggagatttgtctgtcagctgaatgtgccccggggagagagaagtgccaggatataagtgagatgtcgaaccttgaggccgaccagcacggcatgtgtcttgttgacgagtcccactacgacggaaccttgcttgacggcttcttgtgcatattcgacttggaagatccggccttgcggggagctgtagagagctatgttagtaatctgatagtatcgggagaacaaaactttgttctagtggatgagggagcttgggggaggtccatacaaggtgaccgcatcgttgtcgtagttgtttctgaacatggcggaagcttgggtaggagagactcagaagggtgatgaataggggtctctgtcagttcaatggaagaaaccaaggaggagattgagtctcaacaggaaaaatagaggaattaaggcgatgaagtagggagcaggagtggatgggagagagatatggagctggagggcaggcagagaagcactgacgcggtagtactgagagtaactcatgcttaaggctaagctctcactgcttggctggcccgctgcctcaggccgcccgccccatcatccacttccgctgcacgtcactgccttcccattcattcattccattccaatctcctgcttcatccaaggctttggccgtcctcggtttgcggtgctcctcttgtcgccatctcgtcttaatacccatgttactttgactctgctatcctttccacaagctttactagtcaagcttcgttggtgtgaagctcctcccacttctgcctgttgtcgtggactctgaacggtcctactccgcaatcatgaccgccggactcaagacgatcatcgccctctccttcgtatgtcttctttggagctatattgaagcttatttgcttctgctgtttgggactcttgctaattgctatcccggcataggttctcgccattggcttcctgcttgttatcctgtcatcggcgctctggcacaacttcctcccactggtcgtcgttgcgacttacgtggttgctcccctgcccaactggatctgctcgcgatgcgcaaaccccgatgattttatggacagctctggcaatgctgctgctgattttggtcgtttcctcaccggcttcctggtgctgatgggtattggtgagtggatttctcggataggcgggctaggtcggcggtcgcaatcatccctacctaccattgaagccgactgcagactgtgctgcgcctgaatatacatgcccttgttctttcccaactctattgatccccgctgaccattctcacttcactagccctccccgccgtccttgcgcacagcggcgctatcgagatccccgccatgatcatgtccatcattggcggtctgttgatctacggaactatcatcagtttctccatgttcttccgggaacaggaagacttctaaattgccatgcgcaccgatatctgcaagaccagatttcgcattggatacccgctcgcagattgttgatcgaccttttgaagcaagccgccttccatgttcttgaccaatgcacctttatgagacatcgttttgatttgacgtatgctaggcgtactgatgtgttttttgatgccccgggagtaactagctgttgattccactctcgttgttcgatgatacgattgatgtactatagccagtacgaggttatatagaaactctgccagtgcagtgtgatacattccttcattcaaatgtataacacatgcctccacctctttctcttaaaccttggagatgccgatgtcttccgctctgtaattgtgcctaaatggcggtcacgtgggtgcgcgccgcctgggcgcgtcgtgtaaaattacccgcgccgactggtgagtgagcgtgcaacaatgatccaatatcgtcagttataacacgagtaatatgtgaacgagttattccttgtccttctaacatgaatgtatggtctggcacaatatcgctggatggaggcacacaactccaaggtgagcctcgccatccacccggctacattcgccctactcatcaccaaagctaggcctgcaattgattgaccggtcgtcgaactggcaaccagacattggcaaagactccgcgctcagccttcgctgtttcgttaacccgtccctcataccactctatgcacgatgtggtcccaatctcgaagttcacacaaataggccgcagacctcgcaatggctgacggacaagctgacgggcactatctggttggaagatgatgacttggatcggttgcagacgctacaatgcccaattgggctgctcgtggggattgacaatgatgcacggacaaagacttctgaagccaacacgaccgatctcttgatacacggaatgctgtcaaccacgacatcctacgaacgaccgcccaccccgcctgtctcttcaccggagctagaccaccagccgtctcaagttataagacaggaactgagaatatatgccactccaatctctgcacatctcattgccaaaacccaatctctcccatctccacaagataccgatggccacggtcgatcccctcagttccttccggacattcgctcgccaagtcccaagcgcagacgtgtagcaacgctcttcgaatcagtggcgcagcatcataagagagtacggcagaagggaggcgaggctgtatcgcagttaatggcgcgatcactctcccagtcgtcccagcaactgcaaggccttcgggtcaagcgagagtcagaggagccttcccttccccaattggaccggatcgcctcacagcggtcccgctctgtatctattggagcaaatctcaacaccaaacttctggaagctcgatcagagcagtcgaggccaagcagcagacggggctacgtgcgcgaactgaactctcggagaggcacgccaaacccattcgtggagtcatcattacgaagagaaaaagaattgtcaccggaattgccgtctgaagggaagattgagtctctaactgcgcccaaggatgccgataccattattgtggagaacaaaaacacgataacgcggacaatcttgacctgcatgcggctttacggcttcaaccgtgctacagcacgctccgcgagctcgagcaggccgcaaaccgggaccggcagccatgatatggtcactgcgaatgatgagggtttttccaacaccgatgaagatgaattcaaggcaatgtaccatgcgacctatcgcgcatcaacctttgcactgcggaagtatctgaaagagccgtcttcaggcgaaaacgactcgccgaataagccaccactattggagaaggggaaagcaatgacgtacattgatgagttcttgaaattgttttgcgaggagaattaagtctgtctggtacagataacgagtgatgagttacgaagtatatagcacagcgatattgtttgaagccaggaagctatcaatgtttatccaaggtgtataccatcacgtcacagcacaaacatacgtgccatatttgcaaaaaggaaccttaccctatttaattttggtatctcataaacaaaaggtgctatttacaataagcagcaccgcatgaaggattcccttctacaggaagtagatagatagtactagggagcatagatcgggcaggtgattttccggccccggcactgcatcatcgccggcttccccgaacagctccaaccaacccgccgatccagccatacggtgataccatcttcagtgctggcacacaccccattcttcggaatcacatcttacttttactgataatatacccccagcaaaatggacgtctctaacaaccgtctttttcgctggtccaagcccgaatggcttaacaactccgccgtgcgcaacgcaggcgtgtacacctccggcgcactggtaagctcccatcgtcaccatcaccaccaccatcaagcaacgcaaccactcacatggcagtagttctccctgggtttcttctttctcatcgacgccgccgctttctcccacagcgctcgtaacggctccttcgtgcacgtcaaattcgtcgactggatccccggcatctgctccgcgctgggaatgctcgttatcaattcgatcgagaagtcgcgtcttcatgccgatagcttcagttatagtgggagtggggttgcgtggaaggcgaggtttgtgctgttcttgggatttgcgttgctcgcgggtggattggctgggagtgtggtcagtattcacctacatataattccttcccttgttaccctcttatctgttgtttagggtatcggggtcgccggagtagagtggttaggctaacacatggcaatatagacggtcatggtactcaaatacctggtccaggggtatccccttccgacactctactttggtattgcgaatgttattgcaaatggactggttatgctgaggtgtgtattccgtaggaaaacacaagcaggaacatatttactaatgaactttgcgattgcagcaccatcgtcctatggatctcccagaatatagaagacgattacacctataaccttgctctgtgatggatggataccccatacgagatgagatggtctagttgtggtgctgattgattgattgattgattgattggctggtatgagatgaaagcgatactagtactccgcgacgtgttattgtattatgaatgtgcgcttctttcatgtgatcggtctttactactacttcttgttccttgatggaatcatggaggtcaattactctttatgatggttgtcgtgttgttgtataaagcaatggctgcattgagtggtctgcatccttcttgtttggttattaggtagttctgtttttagcatgcttgttacaaattatgactatggatatcattcgacggatctaagttttcctgtagttctttaagcgtggaatgacgttccttgccggaacttgataacaggcatccatttaaccaccaccggtgttggtcgtgatatactacacggcaggagccgagcagagacacgcgttgccaagatcaggtcaatggagattctcaggcaacaatatagtacgctatcttaagctgtctgaaattgtaacttgaaaggaaatactagtagtacgtagtgtcacgaagcatatccgatgtctttatatttcttggcatgatgcgcatgagacatatcaaaacagcgcagggtatctaattctaggcagccatgtggactgccaaggacggtaactagtacctctaactagccatgcaccatgttccatgatctgtattttattttgggatcaggtgggggcgtatggcttgagcctcatagctgaggcgggtgcctgtcacggcatgtcgccctgatgctagcatcgtcaatgccctagctcggtcgacctgctctaggcagtcgacagtctagcatagcccggccatgtaattttatatcggatcacatcaggaaacatgtctggcgtatacgcgcaatgcacgtgtgcctctcaagggcaccacgtgctcgccagatgacgacgaagtaggcttgctaggcgacagcatccgatcaacagtacatgtcacaaatgtcggctgactcttcaagcagaagcctcgaccttgtgagcacggagcttgtccataagcgcatcgacggcatccatgtctccggcgtcgatcttgtcacgagagtaaccctcaggaaggctcttggtcacctcgtccatggcgggctggtagttgcggaccgccgaggaaatagcatagacggccttcttgcgaacaacgggagtggtgtccgcggtggcaagggagacgagcttcggaagagcgttcaggacaatgagctattgtggggtatatgttagctttatttggactctaaatggtaaggggacaagcgagacatcgataacataccttatcctgcgccttttcgttgttctgcacagccgtgccgatgcaccacgccgccatgcggcgcatgtccggttccttgtggtcaagaagctcgaccagaggggtccacagacccaaaggctccaggttgtttgcgttatcgatcgattcaatgagctgctcaaagttatcgaatgcgataagcttgttctccaggtcgacttcatcggagcgaagggcttccatggcggctttcatcaggtcggcttcggagggtccgccgaagagagtcgagagcatctgcggcgtgaggccgcgggagggatcggcgggggcattgttgccagagttgttgttattgttgttttcaccggaggattgctcctcggtagcggctttgatactccatttaaggaggctgttcatgttggggtccatggtgttggagtgggagatggttcggtggtggagagtaaaatttgtgtcggggttggcgacctgtctgataggaggctggacgtcgttgggaaggagaacaggtaaaaaagtgaaattatgtagattgtatcaatcactatgagaatatctctatagagaaaatattgtggtggatgtgatagtccaaaaagatgcgccggtagtctatgaaggtaaagaaaaagcgtgacgttctggacgaatcgagagggttcatgcggctccgacggccttccacctccttccaccgcacgctgacattcagtctgcgagaaaagggcacaacaaatgctgtcctatttactttcacctgacagagccatatactgtatctacccgcgactccatactgttagtactttctctgtatagcctgctatcttggtcaaatcaagaccagccagcggcgctgcagcgtaccccgccatgctcggataaccccgcgatgcggtcatacatgcccgatatgcagtgccttctggctgctgttcaccgaccgagacatttctgcgcgtggcacgaggataccgttagatgaccatgcattcttcactgcctgcaccgccaatgaagatcggcttacgaagaatcaacgcggcccttatgcgattgacattccatggggctggcatcagttctggctaggcttccctctttgaagcccccaatttcagggcccggtgggaaacggcggtaaagaaatctgacagcgcataggaattgaccggaatcgaagggcatcagtcgatcattcctacctgacgtggaattagggacactacagatatggcggagtacagagagaacagcgggcacagagacgatcaggcaattgcattaactaaaaaggatgcaaattcagggataagaaacggccacgctagagactaaggagatacgaacgaggggcaaaagagtacgaaccccttaaaagccggatagaccaagtggttcagttttagtgaacgggggggaaggatccagaagcctgaagtttggaccggtcgggctatgctcatcgtccattctcagctcttggttgttccctggcccgtcggctccaaggcgggctgtgctataattatccagtcgtgggtaagctaatgctgtaggctatcatcatcactatcatcatcatcatcggccaacatgattattgttccaaccttgttctgtggtacacattcgggctgagccattgacggcggcaaccctgggtcggttcagccccacgagggtgcgcaagtgtttttgccatcgtgattcccctcgcctgctcttcctcctgctgctcttctcagttgtcgaaagggccacctcaacggaatgtccgggtgagaggaacagtaagggaacacaagagatcagttgtaggaaggccacaataattctgcctggaggcaaccatggtggaaggttgacatcaggttgagtgtatataaacaaatgagaggacatatccatggaaatgtatacttccataatcacaattgtcacgtcttcctttctttccctcttaagtcgtcttgatacatacatcagatctctatctctctctctctccagagccagattagtaccacttctcagctcagcaagtacacgttctggtccccctttagcgccagagtgtataaattacccgcttacctgacgagcggtactcggcgtgaaagtgtggcggtgacagcactcggactaaacggcactagtgctcccggcggtgcaatcaacggtgccgaaataccgggactagacccggaaaagcctagactggggcccacctcaccccgcctgatccagtccaacctctccctttttcgtgcccgttcagtcactcccctcccccttaagcaagtcagtgtgtatttggcgtaaaaaagggaccttccagactggttggaagaacgctgactggtgtgtattgcctcccctttcaggcttctctcttttccccccctcccatcttgtgactccgtatttgtagaaggagttacttggaaggtggtgcctgctggagacttcattaattaaaattggacttcttgccccctaattgattgatcatatatagtactatctagagactgagcagcaagttcgtatgtgctgactatcgctttcaccaaaccccccccccccccccccccctctcctcctccccctacagccaatctgaccagaaccaaaaccagaccagacaaaaccaaaccagaccagaccaaacccaacgtgaaccaaacccaaccaggccaacccgcacccactcttgctttccaccaccaccgactccctactaacccgacggcctccatcactttccactcctccccccgtttcctccctctccaacctacttacctcaactcatcccatctctctcttgactttactacttccctctcctccctccccatctctatccccatcaactcactcttctctttcttcatcttctctctctttcgtctctttttcttattctccgtagtccgattcttaatcccacacagtcaccatggaaggtaagggcttcctgccaccttgcgtcttgctcgcttcccaagcttctcactccccctcccccctccgttacccccctcaacgcccaccttcacaacttggctaacatcttatttttccatcatctagaggaagttgctgctctcgtcattgacaatgggtatgttactttgggttctcgatgattttggcgatggattcgtcctgcttgttgtggtttctcgccagctccaggggagatggtgcaaaacatacgtccccttttggggcttggtcgcgatgatgaacttgaatgggattctcgcgggcgttgctctattactccctctggcgcttatggaaagaaactaggacagctcgatcgattggcacgcgaggctgtagtctgctcgattatactgacttctgtgttctcagttcgggtatgtgcaaggccggtttcgccggtgacgatgctccccgtgccgtcttccgtaagtcaaccccctcctcatatccgctgtgctggatatccttcctcctggcttgatgggttcttcccactcttcatagcaattgccacccattgcgtccttgcgctgggttgctagcttatgtgggggcggtgaattacccgtcatgttagcaccggttcgaatagtcaactaacttgcggtacagcctccattgtcggtcgtccccgtcaccatgggtaaagctcccctttgtttcccccaagttggcctgttaggctgggtgatcggttttatctaatgccgcccgcagtatcatgattggtatgggtcagaaggactcctacgtcggtgatgaggcacagtccaagcgtggtatcctcaccctcagataccccattgagcacggtgtcgtcacgaactgggatgacatggagaagatctggcaccacaccttctacaatgaactccgtgtcgctcctgaggagcaccccgtcctcttgaccgaagcccccatcaaccccaagtccaaccgtgagaagatgacccagatcgtcttcgagaccttcaacgcccccgccttctacgtctccatccaggccgtcctgtccctgtacgcctccggtcgtaccaccggtatcgttctggactctggtgacggtgtcacccacgttgtccccatctacgagggtttcgcccttccccacgccatctcccgtgtcgacatggctggtcgtgacctgacggattacctcatgaagatcctggccgagcgtggttacactttctccactaccgctgagcgtgaaattgtccgtgacatcaaggagaagctctgctacgtcgctctcgacttcgagcaggagatccagaccgcttcccagagctccagcctcgagaagtcctacgagcttcccgacggtcaggtcatcaccatcggcaacgagcgtttccgtgctcctgaggctctgttcgctcctagcgtcctgggtctggagagcggtggtatccacgagaccaccttcaactccatcatgaagtgtgatgttgatgtccgtaaggatctgtacggcaacattgtcatggtatgttttttcctcggccccttgatgaacacggagtggcctgatcactaacccacctctagtctggtggtactaccatgtaccccggtatctccgaccgtatgcagaaggagatcactgctcttgctccttcttccatgaaggtcaagatcattgctcctcccgagcgcaagtactccgtctggatcggtggttccatcctggcctccctgtccaccttccagcagatgtggatctccaagcaggagtacgacgagagcggtccctcgatcgtccaccgcaagtgcttctaaggtatgtgcttatcatccagagatcacgtcgtatcttgctaacggggtttctatctagctcttgcgcgtgatccgtttcgtactctcgtattcccccatgtattaaaaagcccggagacactggtgacttgcgggcctctctgactcgcactaggaggaagatcgcctgaaaaaggaacttttattttagctgtggaatagagatggtttatttttttttgcaaacgcgtgtcactacggccgcaggccactttgtggcggcaacgagtaagaaaaccggaggggcacgagaagcggtgtaggcgagggaatgtatatgggaccggtgaacttcttttcattcaagtgttcgacctcgtgtttggctcctcttctctcctgttgggcccgtttctgtgccattcttgccttcgggctggttatagcttaaaatgctgctgcgaatgttgatcttctgtggatgatccagtctgcttttcatctttctgtttttttcacttttttttttttaattcctgcctgcccattgagctcgtatgactatctatgacctggtgtctttttcacggcttcagctgcgactccccgtagggcttctccccgtaacgccccttgtatacagccccacaatcaattagatggcctagatctcgttcagctatccgccggcctcgttgtcagcctgtcacagctatggaaggccacccagacctgagaggaccatcgaccatgatgtcatgccagccccttctagaccgcggggaaagagattggaggtgtccgatccagcggctgtttcagctcagctcagctagctagtcgtagctactaggccagatgggtagtcggtttatatgcttggtaggaagctgtgtggagtctgatacagcccggatcgccaatatataccattatattgaatactgccagaaacggctatatctgtttatagaataattgtttcaagttgtttgagaagtgcttagttgcaggaagagagtgtcatacatactactgatatgaaggtatctactatgagtatcatcatccagggtatagatttcacttattttatttctagctaggatgagaggagaagcgagtactgatcgatacgatgtatcttcggttcgtaagatggttaggatgatgggaactttgtagtatgcctggtatatgaggcacatctatacagttcaaaccgacgtttatgactgggaagaagaattgaaacagtggaagtcttgtattcattcattcaaaaacgtaactggatgatatcaaataatgcaaaaaaaaaaaattgaaacgaaaatgaaaggggaggtataatccctcctgcttttctatgaattccatctcccatcccaacccgccgccctccgtgatttctctaagtttgacatcatatcataacataactatcttatcaagattcaaaattatcatatttacgcatcccatgtctccagaccagtcaggatacagccttcctcgccctcctgcttgacctggagttcaccgatctggtagaccgtctggccctccttctggaggagctccgtgatggcaccctcagagcccttctccacagccaggatcatacccacaccgcagttgaaggcgcgggacatctccgtggcggtgacgttgccgttctgcttgagccagcggaagacagggggcaactcccaggtggagacgttgatgtgtgcggccagtgtggcgggcagcatgcggggaacattgtcgagcagaccaccaccggtgatgtgagcaagacccttgatagcggcggaagaggtggccagggccttcaggaggggcttgacgtagatgcgggtcggggtgagcagggcctggcccagggtctgggggcccgtggccgagggcatggtgaagggagcagggtcctggtaggacagacccgagcgctcaacgatcttgcggacgagagagtaaccgttagagtggggaccggacgaagccagggccagcaggacgtcaccagccttcatggcggtggtgtcgggcaggatggtgcgggcgttggggccggtggtgttgatggcaccgacagcggcaccgacggcgtcgtaggactcgtcgatgaagagaccgggcatctccgcggtctcaccaccgatcagggcgcagccagcctggacacagccctcagcgacaccggaaacgaaggcagaggcggtggggacgtcaagcttgccgcaggagtagcagtccaggaagaagaggggttccgcaccctggacgaccaggtcgttgacgttcatggcaaccaaatcgataccaacggtgttgtgcacgccagcagcgtgggcgatcttgagcttggtgccgacgccgtcaatggcaccgatgagagtaggagattcggggtggtaggcggagttcgcagcggccagggagaagagaccaccgaagccgccgatgacggcgtcggtaccggggcgcttggtctgggcgacggagctcttgatcttctggacgaggtcattgcccgcatcgatagagacaccggcggcggcgtaggtgagagactcctggtgagcagcggcagcatcccgctggcggaaggcccggtgggcgatgtccttgcggtagaacatgtcctcaaagtggatggtggcaacgccctcgtaactcttgcggacggcctcctcgaggctggatgcggtggccgtggaggcaatgacacggccgccagcggtctggagctcgtccccgacgaggttggtaccagcgtggaagatcagagtgccttcgggggtagggtccagggtgatcttcttgcccttggcgtaggagccggggtagccaccggccacggcgataacagtggtggagaagtcgggcttgaccttgatggagacaccgtcgagccagtgctcggtgcaggcgaccatgatctcagccaagtcggtgtcgtcggtgagcagagggaggagggtctgagtctcggggtcaccaccacggacattgtactcgagaaccttggggccatccttggtcatcatgagaccggtgaaaaggataccgacgaaggggaatcctatgaggtgattatggtcagcgaaggaaaataaaccgaaaacaagacggggaaagacataccatctctgcgcatgccatccacggaaggctgaatgatggagcggtcgatctgagcgagaacctccttggaggagatgggggtcggggcgtagcagcccataccaccggtgttggggccctggtcgccatcgaagatacgcttgtggtcctgggcggcgggaagggagcggatagtgtagccatcactgaaggtcaggacactgagttcgtcaccctcgaggtactcctcgatgacgacctcgctaccggcctcaccgaactggttctcgaccatcatttcacggagggcctggtgggcctcctccttagtagtggggatgatgacaccctttccaccggccagaccatcagccttgatgacgacctggtgagagacggagtcgaggtactggcgggcaggctcatattcgtaaaagttctcataggcggcggtggggatgttgtgacgcttcatgaaatccttggagaaggtcttggagccctccatgcgggcagcggccttggaaggaccgaagcaacggatgccaactggattggagcgattcaaggttagttacaaacggaactgcaattgttccatgtcaacggacagactcaccggcctggaagtaaccctggatgccgtcgacgaggggagcctcaggaccggggacaacgaggttgacaccattctgctgggagaaagcaacaagaccggggtagtcattgcccttgatgttgacactctggatcttgctgtcgggaccctgagcggtgcctccattgccgggagcgacgtagacaatgtcgacgcggggagactgggtcagtttccaggccagcgcatgttcacggccgccattgccgacgatgagaacgcgcaaccgttccgtagtcatggtgaaaggtgcagggttctctgaggacctgattgacaagaataaggtcagagaaggagcacaaatgtgcgattagagggtggtgagaggagaggagaaaagagagggagagggagagagagagtgtggaggagaagatggagtggatggaggggcaagtgaaaccccccattgggatactttgactcatggtttcttttctgtcaaatgccccagagcaagtccaattgtagagggttccatgcaaagaataaaacacttaattactaacctcaagaacagtctgcacacagagttagaggagcgaaagtgaagagcgaaagcagcaatgggagcaagcaagcaaaccaaactcaactcagtcgctgggaatttttttttttgactttttttatcgattggcggcacggcggggccaatcaatggcacctccgaccccggattcggagtacagcagcagacatagtacagggtagatgaatagttatatagttgattgacatgaacatttagaacagtaagaaaaaaaagaagtgaaagtattagagagatatttctctttatttctcattgttcataatcaagagggtgaatctctcgagtgaacagttgcactttctcaactatactctgcgggtacttggggggatactggctggtacttgctggtacttactgggtactccttgggtagtacggagtactttgcttgttatcaatacccgttcgtatggacagacagattaccacgccgtatccagcaccgtatactattactgtatgcatcataccaattacaaacagcgtattagatcaactccccgggcggtgaacacacaccgaccggcagaaaatccgaagcgcggcgaagcttcgaaggcaaaaaaaatgtagcttttgatcaattcctcaattcattgcttctcagcgtgccttccatcctttaaatccttcttgggctgctcttgcattcttctaccattgtcgctcgttgatttggcccgaatgtatcgggccaccctgcggtctgtctcagaccctttgcgcgagcatgtctgtctttcatgcttagctcgcggcctcgaagcccagccctgggctcgccgcttccacaccgcgcccaggttgcgctcccaggccaccgagtcttcttccactgtcgccattgaagagcaactgaaggcgctggagaaggtatgtatgcgaaatcgggatgctactatgaagggccattatatggaagctcgaaacccatgaatgctaacggcctgctgctgcggacagaacctcccggatagaaggacacccgcccatgtgaaaaagtccctacggacgcaaaatcccaagtcacctcaaaatgcagacaagaaagcggtccgaaaggccgccaagcaagaagcgatgaaagtacgcaagaaggaccctgcaaaccaagcagccgacgccgagactccgaaggaggagaacaaacaaccggagcagaaggacaagaaggaccaaaaagctcgcgcgcagcagaagacttctcctgactcctctacatctcccaagccgcaggtatcggtcagtcagctttaccattccacttggactagccagggtctaactcaatgccaggccaacaagcagtctaccaaactacagctccctgttccaattaccggaaaggacaccggcaagatcaatgcagaccgtgactccgtgaaaggtgcgtcttcttcaaagcgacataggaaatttcctgctggatcactaactagcgcaaagccctcgatgttgagacccccgaagttccgcaactagcctatgggctagacagagtgctgttcaagtaagttgcttcctttgcccccagaaatagtcgattgcaaaacggagctgacagctgctgccttgtacagcccgggagtctatcatcttcgggatccgcgatcgcgcgtttacaatttcgatccataccttggctccattatgcctgtcaccgaattcgattttgaagcgttgaaggagtacatcacctcatccaaggacgagcagctgcggagcctggcgcagaaggagaagaagaagtacattggctcctcttccagtatgacatccgttctgtcgcacttccactacctcctgtcctactggagagaggtcaatatccaacaagtgtcgcggggctttcaggaaaggttgcggaccttcacgcgactcttgcgagctccctcggccatgtttctgcgctaccagaacggcgtctatgccatcgatgccgacaaggaacacgatacggccaacattctcatgaacctgggtaaatcgatggagaagcttttgaccatgccaaaggaggaattcgagcgctaccgacgatctagctccaacaagatctccgcggaagaggagcaggcagtgcccgaagcctaccactactcgacatacggcgatttcctgatgcgttcacagctggatgcctacgacccgcggctccccggcaccggcatgttcgatctgaagacccgggcggtggcatccatccgcatggacgccaagaacttcgagcacggcctgggctacgagatccggaaagcccatggcacgtacgagtcgtatgagcgcgagtactacgacatgatccgggcggcgctcctcaagtactctctccaggtgcgcatcggccgcatggacggcatcttcgtggccttccacaacatcgagcgcatcttcggattccagtacctcagtctgcccgaactggacatggcattgcacggccaatacgacaccgccttgggagaccgggagttcctcctgagtctgcagctctggaacaaggtcctcaacaaggcgacggcccgattccccaaacaatctctccgcttccacttcgagacccgtgactccacggccggtccaccctacatgtacatcttcgccgagcccgtcacagacgaggaaattcacgcgatccaaacgaagaatcaagccgaaatcgacgcctaccagcgccgcgtgcttgacctacccggtcgcgccaacgaagacgacgacacaacaacaaacgacaccgaagacatccctgccgacttcgagtcctccagccccgccgacgacctggccgaagactcagccacaaccaagtccgagacctcccaggacgaagccgagacgaccccaggcaaagaaatcatgggctttgccctcaccgtccgcaacatcgtggacggtgaatacgtggaccgcccgatccagttccaatcccctaacaagtggtccgttgactacgaactgaaccaccttgacagttccaagtgctggaaactctacaatgcctgccaagaacgccgccggaaggcactctccggccgcggcgaggacgagactgatgttgcggccaatacgtatattcgccgccttcgcgaatacgccaagaaaggtcgcaagtaccgcaaggagcagaataagctggatgaacaggagaagctggtcgttttgcgcgattgagcctgtattcgtcctctttctctgtctcctgttttcggctaggcggaacggtagattgaagatgattgattgattgattcactgatggatgattacttaaactatggcccgcggtgcgaggctgcagtcatctatctaatcaatcgatcaatcgatctactctccgactccattccatggtccgctccccatccattaccaactatttacctcaacaatactctatagatacctcatgttcctcacaccccatatgtatgtatactataatgattcaaatattctcctttcacatctctgctgcaacgagcgtcgttgtagttgcagggtgctgctcttccgtggaaatgttcgttctctcttcttcatatcattattgtagacgtgataggcattgtaggtctgtctatctgttggtagctacttgatacttcttgacactgctatttaatgaatagtaaagtatagatgtagttaagaaaaaaaaaaaaaaaaaaaaaggctatggtgaacggccaagataaatgtaagaatcaaccgagatatcatcccattgtagtaagtagtatacacatgtattcacagatggttgctctctacacatcatatcaacaatacaccgactgtgctgacccgaccaaagaaatgaaacaatcaattacaggccactcattcatgggtcacatggtctttgtcccctgcgggtcaattctctccatgacggagaatattctctatgacattaacaattagggcatcaatgggcttcaacgaagataagtcaacgaaaataaaaaaaaggtaaggcagatctgcaaagcaccatcaaaacccagggttctcgaaaggaaagttaaggaacgccacctagcccttgcgccaaacagcaagatgcgaaaccaaagtgctcttgcttttcctggagcaactgcccctcttgaggcaacacatgacagaaggaaattcggagatgagagagggacataaaaggggtggtcagcgtccggtggacacgccaggaatctgagtaccagctggcgagacaggacacagaaccaagagggaaaagagaagaggtaaaggaaacaatggacggtcaaggactgatgagagacagaggaggagcgaacgccgtccactgcctagggaatcggagcttcggtaaggggatggagggaaaagaaaagagaaggtggttggatgtagatggagagccgaacagtgacggcctaaaacacgaggcatatcttcgactagcgaaaatgcgcttgcgagttatcgtgattcgattcattagtcatgtttgagcgaagaacgaatggccccttagcagggcatcactcgaatttccccaggtcaaggggaggtggcgcccactccagcttagggggtcggtccgttgaaacacacacagcgccagatctcatcttctccagcttcttgcgttctttcgaggcgctgccactgaggaagccgcgcagcgttgatgaggctgttccgtacgtactcctcgcactagcccgagtactggtggagaccgtactggaactgcgggcactgcggacgctgctggacttgctgaccgtggatggtataggaggcacaggcaccgccagacgagaggatgatgtgctggagccagtatactctgggggcagcatgtgaggagcatagcctgggaccgagaaaggagccgtctgcgggcgttgtcggagctcagcgaccaggctactctccgcatcaagtcccttaaacatatccagatggtctttcgggctcgtgggctcaatctccggcggcaactgcacgggaagctccggtggtggctggatctcggcttccgacactgccacatctagtttcatattgtccagcatcaacccaaggcttccggctgtggtggggcgtccgtcgctcgaagcgtcatcgtccaacccggtcatatcatcttcgataccgtgggctaagttgtagttacggtacagatatcgacggaggcgagcaacctcaccatcccatttccggctcaacgactggagaataacctcgacgtcttgctgcatgaggggagatgtctcggcaggaacactcaggctcgaggctactgaggcgccggagcggtgaccagacgtttgctgctgtttggacgacttactgctcgtctttccattcatggcggcatgtaacgaacgacggatagagctggttgccgagctctgcgcaaggctcacatcccgcttcacgttccggatctcacgccggacccgctcgagcgattggacccggtcacgatccatgaatgacagactcaatagggatctgttccgctgcagcccatttaccaggaccgtgaacgactgtaagttgatgtcattgttctcacagtatacttcacggagacattcattgtcttccagcaccgaggccagagtgtttgccccctgcaagcccagtttctgatgctcgatcctcagaactcgcaaggacttgttctttttcagaccagtcagggccagattcagaccaattccgaaccgagcgacatccaaatgagcgctttctccactgatatccaaatcttcaagcgtctcgttctcctcgaacatcagctggagcgccttgcacgtctcagggccggcatcatacggaagagaagccttggagatgtccaggcatttcaacgtccggttctttcgcaaggcctccaccaactcctggaactgctcctcctttttaaagtcaatcatcctcattgacatatgagttggtgtcttgttttgcgcaatggctttgaaaaggtacgagcagccttgatcaaggcggttctcattgacgtgaagatgcagatcgcgagggaacccgttggctgtcatggaatgcaggaagatggctacatcctgaccgctgagtccacactggtccaggcgaagcacccgcagaccccgagatcggtcactggccagatatgtggctatggcatcgacagtctcccggtttacgagggtccggctcagtgagagttcctccaggcgccagttgaacaacgtctcgggggtgatgagaggttctgtgcccgaggtgcgagagatacgagacaagtcgagcgtcttgatctgactgaagtagccgaggtactgctggaggatgtcggggctaaggcgaccctgcacacccgagatgttcattgcctccagagttgaggactgagcgacgaccgtagacaggagaaggtcaagatcgtgaactgacaagccacagttgcccacctccaatgctcgcatgtgactggaccgttgagacgaggcatccacgagatagtcgagatccgaatcgcccagcttgataccgttcagcaccacccagtcaacactcgtcagctctcgtcggcagatggggaaaatcgcttcagggattccacatcctggatcatgactttcactatccgacttcggaatgcggctcagggtataagagaaatccaggcggcgaagccacttgctcttcagagtcaacgcacgcacttcctgggacaacaccgataggttctcctgacccgggatatggatcggcgccccagcacgactcagcagagcgtctttatccgggccgtagaggtcgcgtaggccttgcagaacatccaagctgactccactaaatgagatagaccggaaggattcgttgtatcgaagggctcgcagaacggctatcagttctaaagcggtatacttcttttgccgagcggaggcgggcggtaggagcttgaaacacggggcatcatcgcattgcacatcaatggtatatcgaatgttcgaagtgtcgatgtcgtaactggccgagtaggcgaccaatgtccggtcgaagcaaccataatcttcgtccaagctcaccggggggaagttgctctcgttatcgaggtcccgaggaacgatgaagtcatacggttgtttgatccacaagggacgtaagaactcggtctgttgtcgaatccagaaggcaatctccacggaatgcaccgatgcgaggaagaccgagaacggtttccgcgttggcacacggaacgttagatgcaagctatcgtcgccccattccatggagagacaggtcaggttcatcagtccgaatgaggttgccgcatcgaggtcactcaaggataccacggagctgcggctggagatcttgtgcaacgggatcaggtggagcttgtgcgacccaagggcgagataacagcccgtcggtgacagtttggtgagatcttcggatgacgcccgggcaggggacttgctggacgccatctggatcacccggaacattcgaaaggtctctggatcataatcccgctcgtactcgagcatgcggaccacgcaatccgccgtcttctggtcaaagaccagcgggtcggccccgcggatcaattccgccgcggagcgtatgcccaccatccacagattcagttcctggaaatcgggcgtctgcatctgaatgaaggtggctttttgagcccgttcatccacataggccacttccactgtagacgacggtctgccatcgtctaacatgtagaccgcaatgatgctgttcaaggcaatgccggaaatggactcgctcgcagcggctagctgggggtcctgtaaggaactgatggaggcgacggactggcggttggccgccactgagcgggaggtgaaggaagccggaattgaaggaaacatatcggcggctttgctttggttcttgaaccggacgagatgcgtgtccgtcaaaaccaggtaatggctcttctttcgccacatgcctcctgtgattgagatctccccgtggtgcaggataatggagccaatgccttgtcgcagctcgggagggtcctcatccagggacgagcctttggagcggcccagcgaccggtcgtcatcttcttgggaatgcagcgagcgaagggaaccaaacacggaggttcgtcgtttctgtatggatttccgccggctacgaggcccctcaagcgccacggtaggcagcgcggtcacgtaggtggccgactcggaatcggcggtgccgggacgacgcaagccacgggtgggcgtggctctcgggggactggggtgccggaccccaaagaaacccgagttacgtcgcgatttcttcttcagaacctgggcatcgtcggagggcgaccgttcatgagcggcgggggcgggaagggaagaggtggtcattgatgggctgaagacgctcaggctctttctccgctctttcttccccagactctcggccatgacgggggggaagcaggagggcggagaagacggtagaggaaagggacgaggacgctagagggcgagacgagcaggagcaaattggaagtcaaggacgatgtgccacatcgaggaggccgaagtcgccggggggaggtcactaaatggaagaaaaccggtaagaaaaaaaacaaggccaccgaccactgggggaggagcatgatgggacgataaggatggatagacatggctgcaggcctagcctaggagattgagaccccggtggtgactagtgaactagaggggtggagcagggcgaaggagcacaaatgaggagctgtggaagggaagagggggaggaaaggcaggtggaacatacagcaatcgggccagctgccatcgataggaggtgaagaatcaagatggacgcgcagggaggcggcacgattcgacgtggcaatggaaaatgggaagagaaggggaaagaagtcaaacggagacgggggattggggagagaaaatggcgcaatttgagattgggcgcttggaaagagagagagagatggagatggagagagaaaagagaaagggaagcaaaagaaggccaaggaacagtctcgataccagatgagacaatcaatgagatgaaaggcgacagggacaaccttaggataattcgtaactaaagtagaagaagaatagaagagaaagagaataaccagaaatacaatggacccgaagaagagcttaaagaatacgtcgaggggggaggaggaggagagcaaaggaaaagaatggggtgggttgagagaaccgatagtagcgagcgagcggaggactgtcaataaaaaaaagtacgaaattgcagcaacaccaatgcgatggcgattgagatgcacggaagaggagaaatggaggggggataagaaagaacgtccaagcacactccggggcaaccagggacgtaagaaaaggttacagtctaggccgtgtcaatgggcgagacaacgcaacaccctcaccatcagaacaccggaaaggggaaaacacgagaggagagtgaagagagaatcgacgaaagcggacgaggcgcacaagatagaatgactgcttatctttcctttctttctttcctttctttcctgtcgtgtttacaacgtcaacgtctcagtgacccaaagaaagcgattgtttaagcgggccccagtgaggtgaaaagattggatcgaaccagttcctgaacggcaggcaatccggagaaaattgagctcaggaactaaaaactgctgcagcgcgtcttttgggtttatgatgtcagcgcccggagcttcttcggatcccgctgaaataaggaatcaaattcggggatcccgagtctgtactctctgtgtgtgtgtgcgtgtgtgtgtgtgtgtgtgattgatgacaaaataagaagtagagactgaatgagtacgaactagttgactaactagggagagaggggaagatccgatttacaattccctaaagagagagagaggaagagcgaaagacaagagggagagggagggagaaagggaagatgggaggagagaggaggaggggaggaagagagaaaagagtggggaaaaagactaaagggacgagggaaatgacggatcagggggggtaaggagatggagagatggagatggagatggagaggcaatatggagcagacaaagagaaagcagaaaagaatgagcaaatgatggtggcaatgcaacagcacaacgaaacacaacaccatgaatgatgagccaatgtggatggattgacatgacgaggcgagggagaaaaagagagtttagttacttctcacttccagttactctctccggaaagccgatcatcccaagctcgccgaatgcagtttgtgctttttgtctggagatggattctctctctccctctccctctctctctctatacacctacacaatcactactagttatctacggagtactgactactactactacttccttcctatctgacaatctgactaggatgaatcaccaggatgcaactgcacaggatgcgcaggatgaaaagaagcgtaataactttaacttctccttccacttcatcccactggccggtttattatagaagcagccgccaactactaaccgccgcctcacccgtccgcctctctgggattgcttgtcctgattccactagagagagacagtcggatggcaaactgattacttcaggaaccacactaaccggtcctttcgtctcccttcgactccatcactaaactacttgataactaactaatccactcactaactgtccttgatgctcatttccctgtcccaccgttgcccccccagatggagccctttttgaagccgatcgccggtggattgaaacgcgttcgagaagccgatctccagccgcgtacacccatgcaggactggccgccttcctctctcactcactttctcgatttctcattcctcattcctgctccggggctccacttgcatccatccctcgccctggctaaccagctagattgcttgctagatgacttagtagctacggaatagctccagttggccacggtctggagcgctgccaacatgactgacagctgggtaaaatgaacttcggggtgatcaaccgattgggagatcgcctgcatttgggttcatattttcttttttttctttccttgttcattcttcattttacggtgtgcacattgctcccacccagtctgtctgtttgcatctattcccctctctctccaccatatgatctaggcccccttgttcctccctactctaggaccgaccgaccctagatgaatacgagaaaagagacaaaaaagaaaggcaaaggaaataaagggtgcaatagtcttgttcttcagaaacagaaacaccctgtcaactggatcactactgcccctgaatcgaggtcgtcatttggaaattagagatctactggcgtacacaagcggccgattcaccaatctggagatcctcccgtaatccccactgcggccgttcggggactgcagcagcatcgcttctggactttgctagactactagctagctactcttagccaaaccctcccccctccgcgccccccccctctaaccggcttgtccacagcccgaacctggcccgaagggtatccagtatgttccagactgggctgtcgccgtgtttcgcctgaacccttcaaacacgggggttgagatcagtggagaacctcaggtgcccgacctgagggagaaacggactcagcctctccggacatacttttagcaaagcgagacaaagccccgaccgaccgatgtcttccgataatttgcctctcacaaccactgacattagaagatgacttgagacaactgggtccgttgattgatgttggaactataaatctttcaaccttcaacccggaaatcaactttgtcgggcattcccatccatgcctcctgcttactccagtccccgcgcggctctctccgcttgtagtttctcgagccgtttgaccttgcgaacatatttaatgtattcatcgactctgcgctccgcccagatgcacccacccagcgtcatggctccgatctggagaaacactttgaactggggcgtcaagccgcggtaaatcttcgaagcgggggatagccactccgagaagccctccaacgggcgatagaacagtcgcgagcggaggaactctttcgagaagggcgattgcttcggcggaggttgagacggggactgcgatgggacgggggcggacgagggcgacgagaacttgaaaggatgagggaggatcataatcatatgcgccaggatggagacagagccgaactacactgctgtcaatacagctgccttttttcccattcactctagcgcgtctagctgtgcagagcagatgtatagaaggagaagaaaagacatacccgaaaaacaccggtcatgaagccgcggacagcctcggaggtgatttcctctggggggtcgacattatgtcgctgatccgagggtggtggcatttcaaatatatgcagtggcaaaaagactaccactacttccgtagatacagaataaaataaagaaaaaaaagaagagaagagaataagtagttaatgcatgcacagcggacagaaaaacgacagacagacagacagacaggcgcatggcagttctgcaaaccaatgacgcacaacccaacccaaaccccgaccgactcgggtcaacgaaatgccgaatcataccttctgccgtactgtaaaccaaattagtaaaccaaataccgacatctccgcgggtccgaaaccgcagttcgaaaaaagaatcctgatcaatcagcgggatcgattaccaactaaccaccaattaactatccactactcaattgcctccgagattgtctactatccaacatcatcacactctcaccaatatagacacaccacaccacaccaccctccctactctcagacaaaaaaaagcacacccaccaaaatgcccctccccgcgcgaaccgcctcaatcacgcgcataaccaacgagaccaaaatccaaatctccttgtccctagacggcggcatcctgcccccctacgaaccatgcgctcatttcccagccccgacggaccccgctgaagtcgaggcctccaagaagggcatcatccccaacaaagccgccccgcacgccacacaattcaccccgacgcagcaaatcaccattaacactgggatcggattcctggatcatatgttgcatgcgttggcgaagcatggagggtggagtttggctgtgagggctaagggagatcttttcagtatgactacctttttctaggttctatcttatctaggggttgtgaagtggaattgatatgctaatgataatgatggttatagtcgacgatcaccacacgacagaagataccttcctcgcgctgggttccgcgttcactgaagcactgggtgcacggcaatcgctggcgcggttcggacggggcgatgcacctctggacgaggcgctgtcgtgggcggtgattgatctgtcgagtcggccgtgggcggtgatcaacattgggttccggagggagaagatcggggatttgagtacggagatgatcacgcatggattgcagagttttgcccaggcggcgggagtgacgctgcatgtggggtgcacctatggtgataatgatcatcatcgggcggagagtgcgtttaaggcgttggcggtagcgattaggacggcgtgtacgaggagagtggagggagaggttggggcgggggatgtggttagtacgaagggggttctctaaattattttatatagtatcttgttggtggaggcgtctagatggttcggtatgttgaatcaatcacagtcaatcttatgcatatagtatacactatgtcatgttatgttatagatgaccagatggaggctcaggtagaaacacccaaggcttgcgtcgcccgggtccagtatgcttttctatcatcgttggcattggtccccacgcagtcggtgatgtatgccgcccagcctgcttcggaccccgactgcaactgagaccgcacactagccgagcactgtgtggtcaggaaccatgccccggagccgaagtcgtagtcttctttggcgagcaagaggttcaaaacccccgttgggtctccggatacgctggagagttggcccgcgagcgcgggaagagatgccgcgtatttggagttgtacgaaggagattgcatgtttcgtgctgtataccatcattagcatctattgctatctatgtatggcaggatatgagaggagtgagacgtactgccctgtcccggaacaccgggaaagtggttcttgttatacttgaaatcgccgctttcaaaagccataagtgcaatcacggctgcttgctcggcgcgagacgtcacgccataagtgtcaaaagacttggttatatgcgggactgcctgttccgcagtagcgcattccccggctgcggggggattgtcgcacgtattggacgtgggtgcaatagcctcgagctgcgccacggtgagggcagaattatctcggacacggatccggccagccggagatgcatacgccagcaggggcatgatgcacatggtgctcaagattgatgtagacttcatgttgcttggatctctagtgaatcaggacaaaggacagaggctgttgagaatgaaagacaccgtgagcctgcacaagtaccataaggacaagaaaggattatcaacagggacagcgcctttatataagtctttcaaagcatgtcattgttgagacctggcatgcctgatcaactccgcattcctgagggcggagtcagggtctggagggtccttcaacagccaaaggcatgtaacagagcctggcctgttgccacatgttggttggacctttcgttgcatctggcgacactgcgttggcatgtccggagattgccagaaacgcctttggcccaaatgtatcatgtatcatgcctccttgtgctgatattgacagcgattggagcctggcgaacttccggccaaggtgaaacgcccgtcgtaaatcataagtcgtgcttatctgaccccctaacaccttgattggtcgtgtggaagatatgatctgcagactgtcttttggagcctcgttcttcaagaccgttattggtcgttgggcaatgttaatggttggaaaatggccgcagcaacacagcacgaaacatcatcttatataatcaaggagttgaacagtctcgagacaatcacatattagttttattttgccgtccagctagccccaggcgtctgcagctgaaaaattcggttccgtctacccaaaatcgaaagcaagtctatgtagtaacagtaaaagatgtaaggtgtaaacagacaggtgcgaaagtaacaactgtgggttcaagaagagaaggtcaaagaaagaaaagaggaaggtaaatccggacatccaagaaagacagatacaaggcgagcgcgctgcctagcaggttgcctcgcacagatcaaagaatcttgccaaaaacatgtacaagccgtcatgtgcttcaagtgaagcactgctgttaatccatacccgaaactccgtacatgcaccccagaaatcaaatacaactccctgagcggatgagataaaacacaactgagcggctattccacgggcacgacgaacaacggccgggtggaacgtgtcagagcgctagtaaggctgaaaaggcacgcaaagcatagtacaaagggcgacgcttaatcgcgtcggctatagagttcgtacgacgtttcggtaacgccggcggcctcctcgtcttctttgaagctgacgcgacgaaggagggtaggcatcatgcgccgccccatccttgtcggcgaagacaggcgggaagccgaaacaaaggaagggatcttcgagtagcggtaacggtacttggatcccaacagcatgatgcgcgcgtacagccaccagagcgcgaagccaacgacggcagccaggaagaaaccgcagacggtgaggaacacccagtgctggcccatccagaagatcaagcgggcgtcttttccgtgccagctgttgcccacgtggtgcgtgaaaaagctccacgagtacctgttgtactcatcgcgcatcaagatgcggacacggcctgactcgctgggattggtctgcatgtactccttccagatcaccgacaaaaacaggggaccagtcgagtacatgaccgtgatgtacgggaggagccaatggcggtcatacgactgcagcagctcgatcgtacgcaggaagaaggggtgctggggaacagatcccatggcatcattggagataccggtgggaacagtgcgacggacccaggcagggtaggcaagaagaggatctaaccggcgattgcatccctaagatccagtcagacatagtctcaatcaatgaaataaaggctatacacacatcatccagatcaatgtaggtgccaccgtagtgtgccaggacaaagtagcggatcgaatcagcacgctgaatgggatacttgtagccatcgaacgtctcgaggaaccaggggtactcgttggcgatgaattcgcgcgacttttcgttggtccagagctgattgagatgcgtgttagcaaaaaaagttcatgtgaacgaaatgtacatcgacaaggctgaacatacaatgtattcgtagtctgggtgcagatcaatgcagctctgttgggcttccctccatacttccgggatcgtttcgttcttgtatgtctggtggatgatcttgggaatgatctgagggcgttgttcaatcaaactggagtttggcgaggggagctcggcgcggtggatagcgtcggcggaagcatcttccaccagtagggaaagaagtgtaaagacgcttcgcacgaggaatgtgacgataatgagatttgcgatgaggaaaatgagaagtccacgtcgcatattgacagagagtgcaggggccgtcaacgacacctgctcaataggggagtgcgcaagtatacagaaatgaggcggattcgtatcccgatgcaaggaccaatcctctgaaggatttattgcaattcgtaggttcgtggaacggagaaaggaaaggtgcagacggccgtgagggattgagacctaatcgaacgaggatctgctctttcccacgggaagggcctgatgttgatggtgcgataagagtacgccggcggaaaatagatgcgaggctcaacacggtactaccaacatagactcgtaggacaggagtgggtgcaccggcaacgtttcaaggcaattgcaacgtgagcgtccgcggggggtgtattatgacctggggtcgtcaaggttgactgaaggaatgaacggccgtggaactttcttgttggctctgtttccccttttctgcttttagtttactctgtagacggatggttgagtctaagaggataaagcgcaacgtgggtgactgaaccaggaaaggaccggcgcaagggtgagagagaaagtttggaccaagagcagaccacttagtagtatagaactaagtagtggtggtggtggtaatggaatggcctaggggaggttgatcggaagccccaatggcgctggactgcgggcggggggtggatttattgggaaaggtaacgaaaagaggaagccacagaggcgttgtttaagtaattgtagcccaaaacagacaagaagattggaaaacaattaagtagtagagggagtgcgtaaattacttgggtcgcaagggtgggaataaaaaaaaataaaaaaaggaaggggaaaaaaagaataataaaataatgaatgaaggaatggaaattgataggcagagagccaggtacttgagggggggtgtgtgtgtgtgtggaaggaacgaacgacgccttagcaacaaagcagcggcatcaactagtaagaagtagtagtaaggaacgatggaaaaggcagtgtagccgtcgagaaagtaatccctttgcgagggtacctggggaactgggaaaagggaacggagaaagccagcgagtgagcgaaagagagagtagggagagagagagaggggaggaggcgggcggcgagtgtcaacaacggcccatggttacggggagccctgaatggtcgaaagtgtgtcgaatggaccgtcatcggcgccaggggacacagcttcgggttaaagggggggcgcagaaactaaggaaaggcgcctctctgggggagagaaagcgagaccgagagagacacaaacacagagtgagtgagaaagagagcaagagcaaaacagtggggagacaccaagccaaagaaaagtggagatgctggagtggatgctttaggttggcgccagttgctaagcctccgccactaagactctttcagtcgtctcgatgcccggtttggttagtctcatttgccgaccgggactagccatctcgaactcgtaacttgttgagaatattactacttaaccattattataatgataatttattcgagtaatgaatagtaatcaaaaatattatacaagaccttgttaaatccagagaacaataatagtaccttgtatgaggggagaaagagatcctcctcactgcagtgccagtggcagactgcaccgccatcaaagtataggtacaccccgaaaatcaacacctggtgatctcatcagcctatcgcactgccattcttccggctgagccatgttcaacgatgacgcctaagacctcgtggttcatccttccagctgataaacttagtactctttccggcgaaagaaagagagaaagggagtcccagcctgatggctgagccactactacgtagtactacttactcggccggcggttaaacagtaactaaccaccaaatcaatagctctccagttcagtctaagtaagtacgtagcctcgttaagacgggacattaattaactgccaaataatccagtggttggcgaccagccggactgtggggccacctctggcaatcccacggggccacggggaaaggtaaacccgcttatgtaactgacgatgactggcggacagccatccacgctaatccaaataggcgaggaaagcgagggagcaagcaggaaaaaaaaaaaagaaggtaaaattgggagaaattgggagagaaaatatttagaagaagccaaaacggatctcctcacagataagaaagaatacttactaactacaaagtcactagtcgataatgagaaagtggctcctccgccaaaccattgaggggcgattacgcaggcctcggtggtttcacccccaatatgcttctggcattctctcccatggatctgtggcatctggtacaacaagcaaaaaagagtaagtaaaattagttttatttggttcggaacatgaatcgaagacgccaccactcgatttcccccctccccagttcagtctcagttcccccctcatcattgccgcatcgtgagaatctttgttgcctaattcagttcctcggtatcgctcagtcgctgatgcgctctttacgcaccggcgaaccaattactccaggtagaagacgcgtcctgccaccatgatgacggagctggcctaatttatggtttctgcacatccaacgagctagctagttaataacggtcgcgactattactgtgccaatgcggaactacgtagaggaaaaagcaaattttccgacagaaaaaaacaacaacaataatagtatggagtagactactgtgtaagagattgttgagaattgttggggaacaaggcgagttagaacgaccaagtaaatcctctctgttcgtgactactaactagctggactaaatccatagcgctgcacgctacgtccggaaggtcagttctagggactgcaggaaagtgtgatagtcggtttgaatcgcatggactcatcaaactagacaggtactagttcggtcgtggaatttctgggccatgctccatatctcccttgacccgtagttcccagtactgcaatccaagtgtcaacgactcaaccactgcagcacagtctcaattactccgtactaccatctactttccattgatttcctgtctgtttttcgtacttttgacgctcacctttctgccgacaccgcggagcttctgctgtcgaagccgcccgtgcataaagttccaggtagcatttcgagagaaaagcaattgtccttgtgtaacacggcagctgccgcataatcgaccatgttgaagtgacaagccagattactggcaatcgttccagaagtaagcctatcacagcgtttggctacttcccagatgtaagtactactactatgcactgtatgtctagtggtgatgccggcggcagccgtcaattgcaacggtgattggacatgatgcaggctgtaatctagtttgtagataaaccatgtgcacttaagcaggattgagtggctagccgtatgtgatctatctgtacctacttacagtagatagtagtcgtgtcgtcctgctgtcggtttgccctaccacacagttagccagtatctgcttagtagttcagatccagctcggtgtctcaggcaattaccatttaaggcaggtccaatacacagcccagcccaaacttcggcgtctaacagagcaacacgattgattgtgattgattggcatttgcactgatttgccgatgtataacatcatatctgatgtgcccggcaatgagcgagtaatcacagcggggcaaaaacgaccagcacagcccactgtgcttccttcccttccttccacgcgacgagcgatcaggcagaagtgggaaacgctttatccatccagaaaggcttgtttgttcattcgaggatccatatttagaagagagtcaactcagtcagtcagacagaccactcgccacctgaaattaatggaaaaattcaatttgtccagggttgtctgtccagccacaatctggtgtcggaggttcgtggctgggacacaggtgtatcttggagacaactgggatggatggagaacgttttacccgccgagcttgttacagccattgattgcacccccatggaccctggtcgggatttccaactccaagtttggttgccggattgccatctggctggcatgaatttacgagtacgagttgctgagagacggggaatcggcggtcggtggttaacccgccgacacaccaggtaccaccaatgttattctcactgtttttgtcttggtgggaacttcgctggcaaattcatccgagctccactgatatcagatttgacaggttaggcgggctttgaagtgggttagtggtgggtactgcaacaagtatttttggcgtggggtcgtcgtaacctttccatgtgaaaggcaaaatggttcaaacagggcccggggagaaaaagagggccagacaacaaaaaccctccaacagggtgcagtactaatataggtatcacttagtctaactgctaagataagtctcatgcagccatgcttttgccactagatatccgcccaaactggggggccgtttcacactttatccgaccagcaaagcacatccacgaacctgataagtctatccccagaaaaatgccaagtcttttttctacaccaaaagataaagagaaaagggaaaaaaaagaaaagggaaaaaaatcgacggttaaaagaaacccacgggcccacatccacacatggagagaagggggccttaatccatgctaccaggagacacatccaatcagaccttctcacatacccagattggcgcaagaaaggcaccgatctgactgagtggctggcttttgatgtttaggcccacaggacgaggagaaaaatactaggattggaatgcatggcaacgacccgcggttgtcgagtcgcatgttcttttgtgccagatttcttctgatttgtagttcaattgggagtgtcagacacgcctaaattttatctatcccttgtggtgtgtttcaaccgaccagaaacgagccccggtggttcccccgtttatcccccctgattggtgccttgggtccgtgcctcccacgtactcgtatctcgatttgctattctgcctcctgtctttcttagacaaggtagaatattgactgattcgtccatgataatctcatccctatcacaaagcaagaacaagagatcatagacacaccaagaaaaaatcatccattccatctcactaatctgattacccgcagacgaggggcctaatctctcactcagccctcgtctactaacgtctaacgcatccaaatttagtaaaaatgacctactacctatccatctgtctatcttgctaaccgtttcggccttctcatccaataaaaacaagtatataaaccaagtgttctgtgtaggggaatatgcaccatcatggacccctgtccccgtgttgatttgttcatgtcaatcaccccccactctcacccgatgatctgtaagtcggatgaggtcagagcatgctttaatcccgcacaagaagataccaatgtgtagatagctagtcttcatggtgagagaattaagactatcttgtctttgatcggccaaagcgtctgtctctgactggttgatcaacgctcaggcagagaagtattgtcatggttgttctacatggtaactataccggtggtgctatgtaacgcggggaaagagaggaagtccagatcgatcgattggatcaaaccatacgatactgaactaggggcaaatcctggatacaagtctgtatggcattgattaaaagtgggaaagaagaaagtagaaagcgacattgggatagacattgcggagaatttaccccaaacttcgagcttgcaccctggatcgacacgtgggccgcccgttcaggtaattgggatgctacgatattcctactgcatatgggagagcagcctcatgcgtccatgcgttcacggcccccctcctcccctctcgcaaaatgtaaattatcagctaaaaacatgacttgggtattttcattgaactactagctgattgatcgccatgatagtctgtctctcttacagacacacctgttactaacccccgcagacagagcgcccgctattgccttgatgatactcctctcttcctttcttgcacatcttccccacaagtgatcccaactccttccactggttggcgaaataagttgattgctctgcctctcgcatattgatactcggggactctgacggtcttgtccttgcggcatttctaataggaggccagagcgcaatcagccacggcggcgtgggggcagatcaaatgactctccctggacaagacaagccacacgataagaaatcccatcaagtctgccgccgtgatccttgcttatatcctgacagtattaacttctcatgcttcgcgcgtgtcggcgcgagtagttggcagtacacacatatatgctgacgtttccagagcgattacgcggacgattctttgcatcgccatgcagtaaatgccccagtggggtgcacaaatagctcaccgaacttcgggtgcagcagcagcggcgaattccccgttgacgttggcagcgtcggtgcctcgttccccgggccctgactcaaacagacgcacccaccacataggaggatcgaaaggacggtgaccaccgtgaagcgaagggtaaacatcgttgaagaagtaccagacgtggccgacgacaacgccgcagatttcatccttgggcacgatgccatggacgaccaggctgaatgccatcagaacccaggggagatagggggcggtgaagaccagcattcctaggaagctgaggcgagtttccgggttgcgacgactccagatgtagaccagactggaagagagagccgtgcccaggaatggaagggagagaaatggcgagaggacgaggagagaggccatggcgtagaacagaagccacgagaagtgggccggcgatcgccccgatgattcctccaagaggcgcgagtatcgctgcaagaagaacacatgaaatagtaagtcgagattgagtggtccgaagtataggaaggttgtgaacagacgccaatactatgcgatggttagccgcgtgattcgtctaccctatacagtggacggaagtactagctgcgacgtacctgagacttaacatagactgcgcggaagctataaaacagctggaatggggtgaggacgtgacattggaccaagactgaagtggcaactgtggctgctgtccaccatcgagttacagggggcatttcatagaaccattgctccagcgggaactggccagcctgcccgccgttaccccagatggcggccataattgatgggtagtagagttgcgaacgttgggattaacttaggggggaggttgctcgggtggcgggtacgatgcgacgaagcggtaagcgaaatagagaggatgcagacagtcgtcttttggcgtttaaggactcgagagaagacgggcgagtatgatcgataaggggatgatgccgaatcaccactaaataactgccagtttagttccgccgtaatcgccgagctccagctggccttttggcctcaggtgtcacctgtcactccccggcccatatgtcacgtgtcgctcccgcgcgcttcgacgccgcaaagacgcgcctcgcacgcgtccggacaagaattcggatggctggggattccatcacttcatagtccgttcggcctcccggatgggtccctctctcgcatgcaatctcatccctgacaaacgctcctccgcggttttcgccttgcagcttatttctcgactgtgccagtcgatcgcgcccagagctcaattcattcaaagcctcaggccgccggaggacgacgagttggcgcaccacctcaacaccatttaaccttaaagcgtcattgactcgcccggcgcgaaggagctctacaaagctacccctctttcgcccctctcgccttgaacaccccaaccggccaattgctcgcccaagcgctaaacaagtcaatatgcctcccaagacaggcggtcgcggtcgcaagagcattgtggcggcgccgcgacaatcaacagctggcgaccgtgctgccgcaagctcgtcgaaagcagctgcaacgacgtcgccggcagctaaaaaagtgcgcaaatccactggaccggctaggggagggaaaaggcctgctggaaaggcacccagagagtccgacgttcagcgtgcgtacccccaccttcaatccaaaatcctctctgcgctctctctctctcctgaagaatgaaaattgacatcctcgcagctggtgatcccacaccacaaggacgtgtacgccgctacaagcctggaaccgtggctctcaaagagatccgcaagtaccagcgctcttatgatctgcttatccaaaagcttccttttgctcggctggtccgcgaggtcgctcttgacctcctcccttcagaagttggcgccgagctgcggtggcagtcgcatgcgatccaagcgctccaagaagcagccgaagctttccttgtacatctcttcgaggacaccaacctctgtgctattcacgccaagcgcgtgaccatcatgcagaaagatatccaacttgctcgacgcattcgtggtgtctggggtggtttgggctaaaagtcttccgttacccttgcaattgatcgaaaggagaagaagtcaagaaaagaaagaaatcgagacaaaacgcccaaaacaaaagcgagtttctctactttcacaatctacctactctaccctaccacctctctgatctcatcactctatcttacttctctccttttcgaattttttataatcaagcagtgggcgttcatcatcactttttgctgccaattggtgttgtatagggttgcaggcgtatgggaaggttacggggtcttgaggcgaaccgcggggtctttctttgtttttgatgctgttacaaacttctcaccgattttgatctcattttatctacctacctacctcttgtttgattgattgttgactctatgccgttgactaccggctgggtcacgtgtgcgtgtacaatacaacctacttatgtccgttgaatcgaacatgagaggtgtactatctattccatttcatatatggtcgaatcggatcgatcatcctgtgtatgccaagtccttcatggatgcacttggatgtctgatgttattgatcaagaatcaaaagaatcaaagtcacctgaaaccgggatcttattgtatcactatttattcccataaatagaacaactcacacgcgcactcccttttatcaatgtcaccatgacgccgtactcccctcataaatagcaataacctcacagcccagacagatagagcagatagacacatggatagaacagcccaacatggtatcatgaactgaacttcagccgtaaacaccactacatagatatagaaagcatgaaaaggaaagggaaaaggggaaagagaagaaaaggaggctgggaatgtagaagaggtaggtaggtaggaattacaaaaaaagggctaaatagcaaagcaggaaaccgccactaccagcagtaagtggtagaaaggaagaagaaagagaacaagagcccgtatctatacaggtctcttcaaagcagacggcaatcccatcatcacgcgatgaccttcttcccgtacacctttggcctcctcattctttccttgacgttctagcgtttcggctagcatttcgtcggtcacgctgacccagagccggtcgttggctttcttagccatggcgcggcccgctcgggcacttttctcggcttgttcgccgacgacgccacggaagtatttccagctcatgaaggttagggtcatgcaggtgatttggctgttgctgattgctgtggcggattggagggcttgttgcaggtattgcttggtttgaatcgtggactcggtctgaacggttgcgcagaccaggtagtatgctgcttggatatacttgttgggactgccggtgcaaaaggattccacggtagataatatggtgggtaggtgggagtgagaagggtgggtgggatcacggaggatgaggacggtgtttaaagcagcgagaatggcgatgtcgcggcgtggctcattgcgcgccgtcttgctgaagttagtggataatgagagaagaggagattggaaggcgttcagagctgcggtgaggtcgcctgttgcttgtgcaatagcaccggtggcatactccattaggcactcgacggtatctgggagctggtcgccaagttcctggccttcttctcgaagttccttcaatgtcttgttggcaagctcccaatctgtgcgaccgcatgcaagaaaaacctgctggacgagcaggttgcaatagagaagcctgcgccactgaacgcgtctattcgcactgaccaccgattctgtgatctcttgtggcgccttgaaacttcctatgacaacaccgtcagtaacacatttggaaggattcgagatgatcttcgccgaatccaggtgtactaacccttcaacatacgagtgccctcctgcaagaacttctctgccttgcgtccatcatatgagtttttgcagctcagtgtgatcgaactaaggaagtagcagagcgcataaaggtcgtgctggggtagccaattgaagcttaacagcagcgtgccgctctggacctggaggatgtccccggtgtcgatggaagacggaccggccgacttgccattcaatgggattgagaatgatccatcgctgcgccaattcgagtcattcaagcgttcgtccatcaaatcttgcagcaccttcagcttttgcgatgattgattgatgtcgtattcgagtagactgcagcaaatatcgacaatttggactaaagtcgttagctgtgggatatgccggagttcatcattgagttggtgactccgcgctacggctaccgcacgctgggcttgctcgacggagtcaaacccggatccttgctggaggtgcgcgagagcttcgattatcgcagacatggctgagacagccctatcaccattgcggctagccatggtggcaatcttgtgaaggtgctgtagtgccgacacagaatcttgatgggccgatgaggaaagtgaaagggacacccgaagaaaacgaaaagcgtattcccaggcggagtggcgatacctaacaggttcagcagatgacgagagaattggcgataccggtacatacgcttcgacatcttgtatcatcccatcaacagctttcagtgaggcctttggattcgtcttatacagcattcgcgccaacagatgttgcatgctatatttcaaatcaagcatccgattctacattaatcagtacctcataatcgcaatggctccgcgaatggagaagatgatataggctcaccctttcgcaaaggtcaatctataaagggaggttagcaacagcgagaagatgcagggcaggagttaacttacacccttgctcaatgctgtctccgcttcaaggtcgttgtctgtttcctcaaacaatatacgggcataacgtaatcggactagagcttcaacacggggctgaagtcgccagttctgcgccacattaataagcatcaccacaacataagtatggttacagaagtcaagggttaatcaaaagtccccgcgtaccttgagaacggcttccaagcaaccaagacctgtagcaactaatttgtaatattcgtccatctccatctcccgccttaacaaggctaccaacgtgccatgactgtgagcagcattcagatactcatcagccatggccaacagcaatacttgatagtcgatcggcgtgcctgctgatttttgggtcggtttttggccagtttgtcgctgcgcttgcttcttgatgggtgggcgctgaactttctgctgcacttctggggtaggagctgggattaacacctggacaggcttaggggacggtgctggaggagtctgagcgacaggtttggcggcggctggcttaacggggacagggttggcagcaactggtttggcagcaggagcaggggcaggagacgcagtcgcagccacagccgcagcagcgggaggtggcacttggactgaaggcgtagtagatgtaggttgagggtaattgttgggagtttgattcgcttgatttggactcggggcggaatagtacgtggatcgggcgggggtagaagtagggaggactggggagcggctgttgcctgcaacagacaccgctggttgtgcagcatattgggacggactattggtgaactgaggaggcgaggtagaagcaagcggtggtgggttgaatagatccgacggattcacatattgctgttgcggctgctgctggggtggaggctgttgaggtggtggtggtggaggttgctgttgttgcggcggctgcgggttatacgtctgcgcgtaagcaggatacgccgggatcatgacctggggatagaccaccggcttcccatattgatatggcgaagcgctcgtattgacattgctgttgtacagtagctgctgcgggtggatggtctgctggtgatgcggcagattggggggttgctgcatgtactgcgaaggatatgggccgttatggggtggtgggtagctcatcgccccaggacgcagacaatgctcatcaatccactgcactctgctattcccgggaagtatatatagcgagacgacgaggatgcttctattttttgggaatgactctctctttcctgttcttctggatcgcgccgccttttccgtttccgcgtcgggtcggagaaacccccgggcggtcaggtgaggcgcgatcaggtgagttctacgaaccatggactaacttggctgattgattgctatccttgctgcatgacaataagggaatgtagggagaagctccctgttcttcgacggaacaacccgcatcatctagaagtctagaatatggattctttcgaagctgcatacggagcattatatcatgtgcattggaccgggtcttgccgtaaaaccctctctctagctaattatactatatcccgaacatcttccatctagcaaacaagccgacatcacgatggaaacaatgataatacacccttccaagccaaactattcaactcgaaagtccttgcataacgccgaaaccagatccgtctagaatacatcacacacatgagattcgtgaccacaccaatcaaccctaaatcatactgatcgaggtatacagctgattcatcgactgatcctgtatagcggggttgaggatattcatatccaaagacggtgcttcttccagaggtggatgttctcggatcgtccacgggcatagctcactgcaatttgcgacatcgattaaattctccgcaggatggattcgttgcgcggcccatgtctgatctgggacaggccccggtccaccaaggcacctttcagtataaaagtggtatgttgcttgtcccgtttcctcgtcgactcgacatggttgtttgcgaggacacctcagtgaggcattgcacgtattacatacggatattcgcttgcaggatgcgcagtggttgtcataaaggcgacagagagtggtctggcatacactcgaaagccataagtcaaccgaccggtgagcacaaccaaagcgcggcgtcatgtgctcttccttgccgagctggccggaacccgtgcgcaagcggtactctgtcttaatcttcaactggtcttcgtcgtccagctcaggatagatctcaatatccagctgtgttgatccgtagtcctcagtgcaactatgccagcagaaacgctgctgtttcatcccggatccaaattggaccgccaggtccgttatggttttccttcgtactctcaaaagttcaacaagttccatcttatcctggaaagtcagtttcttgcaaggacataggtctactatgcctgccgaactccctaggttgcatgacctatcctcggactttcgtttcagctctcgtgcgggaaagaagctcctcggatggagcttcaagcatcgagaacatgcccgccacctgttatcttccagcaagtttatgaattgccagcgtggggtgacgaaattgtgtccattgcgatagtggtggaaaagtggtgcgaagtctcgactgaaatggaggggtttggcacccagggtagcaccgcatatcgagtagaggcgtttacaggtcagcgccagacatgcttcgggcagcaccgacaggtgagaaataatttctaggagcagctcggtcggtagcgcgaggagatagcagttggtgatagtgtctgtatcgccgactttcccttcatactgggttttcgcccagcgattcatctttgcgatggacctcaatcgttccccagcacggcggaaactagatcccatatcaaccggcagatctgacctcatttcgtcgattgtggcagactgtatcgtctgtatgtaagtaacagggaaatcgaggtatatgtgctgtgatctatagtcaaaatgtaacaaggactcagaagaagaaagagtaccagcccgttttctgctggatttggggcatcatggtgtcctgggaaatataactgaaagcaagccacatgacaaacgagttgtcaagaggaagacgggacagagggccttttgaccttcaaaaagtaaccttcgcaaaggttgtaaattcgcacgcaaacggagcacgcgccggggtcacagcgtagtagagaccgtcaggattacatacaacaagatgggtcttccgttggaccaaagagcagaagggcgattgtttgatcaagctccttattggcgactgcatccaaacagtctacggatctagactgctatcgtatcagttcatagaaagggtttcgcccgactggggaacggctaaggaagtctatgatgctatcggattaaggcctacactgagcttccgcatccgggcctgtgtttaccgcatcgatcttgcagcgacccgcaacccacccttggaagaatgttcatgcttctaaaaatgcagcagtatgttgcgacaccattttctgggaccgcaagacaagatgggatgaaagatgcaacatcaagtgacgtcgatctggagggtgtcttttggaggggcctcatgatccatagctgagtcatctggtactgctgactgatcggcgcgataacgataaggccctgtctgataagcacatcagatgagccttactggatgaggcaatgaagccgaggcaattaagatggatgggtctttttccatcccaattctttcactgttcggagtcgcagtggttccccgtttcccctttttagagctgcaggtgattatagcgtgctagtgcttgttctatagactcttcttttggcgttgcattacaaccagatccgatcctccatgtcatttgttgacacccccatcagcctcctaagcacattctccataccgcttcttgtggcgggcctgctgggaatgggcctgctctcatggatccgccctaatggccggatcgcatactatcatgcgaaagataataatcttctactgaccacaaaggctgagaagtcaagatcccagacgcaagtgactctggcagacctctgtcgcactgccactccgaagacgtgccagctgaaccccttccttttcaacggccatctacagactgcctggacaagcgtgaaatttgataatgtcccggtgcactacaagcgctggatgttcgaggctgagaatccgatgttgtctgggcactttgcgatggactttgtggtagatccatatgagccgcctagcgacgctcatgcgactgatagcgagagaaaatatactcagccatcggggctaccggagcggacgtcattcttctcagaggatgaatttgctgcgcttccctcggacgataacaaaccgatgctcgtggttctccatggcctaagcggtggatcacatgaactttatctgcgccatgtgattgcgcctcttatcaaggatcagacatgggaagcttgtgtcgtcaactccagaggctgctcgcaaaccaagattaccaccggtgtgctttacaatgctcgtgctacctgggacattcgtcaggctgtcaaatggctacggaagacttttccgaatcgtcccttgtttggaattggtttctccctcggcgcgaacattctggctaatgtaagtctatgttaggcacaagcaaccaagattgactgacgtgatcgtagtacttgggcgaggagggcgatgcctgcgagttgaaagctgcagtgctctgtgctagcccttggaaccttgaaattggctctctaaacctgcaaaacaccttgatcggtcgcgaagtctacagtaaagtaatgggcacgagcatgaaggacctgttcgaacggtaagtgaaatattcctgacattggcattgccacatctgactcgagaccatcagacatgtggaacaggtctccaagaacccgcgaatcgacgttgatgaggtgaggaacatcacttacttgcatgaattcgaccggtaagacatgactgccagcttttctacaactgcacatttttaacattagccacaaatagggctttacaatgtgcctcgtggggctatcccactgaaggagcatactatcgcgatgcttcctccaccgatgctatgcttggtattcgaattccattcttcgttatacaagccgaagacgatccggtaagtgcaggttttagcagtcgaattatatacactaaccggcagcagattgcctgtgccgctgcactgccattccaggagatgacacaaaccccgtacggcgtgatgatgactacctcttggggtgggcatcttggctggtttgagcttggaggtggtagatggtttgtgaagccggtatgtgaaagccacctaccacttgtctatctacatctaactgtttcaggtcgcgaatttcctaaacctcatggcgaaggaggtcgatcttagcgtaccattcaaggttgaggatccggagaagatccccggtcatcttgcccaccatacgggtcccgaaaaggacgcagatacggcaccgaagccgaaatttattcctgcgcaacgcaagctcgacctgcaaatcaggccatagtcaacactattgcataactgaactgctcccattgataggatcagtgcttcaattggagagatgctcatcatgtgtcatgcacgccgttgtttcggaaaacatagaccagtataacgccagagacccatctaactacatagacccggtatagacagaattacttttgtacatagaacttcaagcaaatgcaacgctcttcttctttccttttgacttcgaagatgactccttggttggcgcctcagcctttgtttcgctggagcctcccttgtgcttgcgtttttggcggatggactgctttgcatcctcctgttcgggccaaaccagttagcaaccctcaaaatatagtccttcaacgggacaaataggaaataatgagcatatatacgcaccagcttagacttcttctgcgcctgtctagcctctgcctcctttctcttagcctcacggatctcctccaactggcgagccttcatcatcttggattcgatctgtccttccttctccgcatttaccatagcgaggatagtcatcattccctcctattgtaacatcgttagccaatgcgacattcatagaacggcctaaaaagtagatggaacacgtaccgcatcgtcaacgaaagtcttgcccttcttcttgcccttgggctttaccacaccgacgggggtgatcgcattcagcttgggcagtcccagctcctcctccgtatattctctcttcttcgtcttcttcagcaggctagactctgtgcgcgccttcgacttgacttccttgggcggcgggcgcttggcggttttcttgttcactttcgatgcggacgagagaggcttgctcttctttgcgtcgcccttgttcgaggccttgccactgccggagcccttagtcggcgccattgcttcggtttagctctgcgtgtcgggattgacgatatggaaggtatcgaaagagggagacgaaaatctggattgtcgcctgcgatggtgggggagcggagaaaccagccacaaaagtacagtcgcccgaatagcacgaaaaccacggacctcagatatacccagaagaacgtaaataaaccgaatccaaggcgaagaaaagaattgaacgatgaagccccggaccctccaagatcacgcctccgaaagagaaattttttgaaacaggcaggcggtgagccgcagaccgggacgcaggacctccaccacttcgatctcctcgcatcgtcaccttaaggttggaccatcgacttcccttccttttccccattcgctctcctcccccaccgcggtctttctctcccctctcatctcaagtgtgccattgtcgagcctcaccaccgggccactattcaagatgaccatcaacccgaccttccttgcccagcgcacgcgctcctgtacgttttcccttcctcccaggactcggttgtcccgaccaagtccgacctttagaaattgccgcgacgtcaatggccggaatcccgagctgacctttctcgccctgtgtagctgccaactggggtgatgcgaagcaccgtgtcctcaagtcctacagagaatggcttagagcggtcagtgatccttatactcgatgatttacctatgcatcatcacccaatgcccgttcatcaatggcttgctggggcctggcgttcccggcgtggtcgtcgaccctttcgcgtctaccagacagaacctgcgacggaccaaatcccaacttcgataattagcattctacgagaaacgctcagactaacatggtcccatccaattgagatgatatagtcccccgagattcagactatgtactctctgaacctccccgtctccgctatccgtacgaagatccgccaggaattcgagaagcaccgctacgtcaaccagctgaacgttgttgatgtgctgttgtaccagagccacgctgagttccaggtgagtttatgaaaagtgggcagtgtagcgatactcaattgctgccattgatgccgcccagcccgaccaattgagcctcatatggtatagataatgtgtcctgaccaacatcaataggaaaccctcaactactggaagcagctgtcgcatgtgatgaagtacttccgtccagaggaggaccccggtgctcggctacctcccaacttcatctcgggcttcttggaaggccgcaattgaaattgtgaaattattatcaccatcatctcttatcacctctttttatatttcccagtatccttagcattgaaagttctctgacggctgcgaacgctgatagagtgtgtgagtgttatgtaaatattgtctgactacatgatgtttcggttgttgaattactcaagggtgcttgcatagtaagcatgtagactgtattcgtatgacttgcgattcggcgtgaggacggtgtttcttcctattacctcttggttagactatcacaaagagccctattcacatgaccaacccagatatctatgagcatatagtagtagatgctacctatggtatccctcactccctccccatcaataagtaccactgcatctccagccaaccaatcaaccaaccaatacacccacaacaaaccccattacatctaaccaccccaagagaaaaagaaaagaagaagaaggaaaaggtataacttttctatacacacacaacgccatcatatcccatcaaacagcaaaaacatgacacacacacagatcaaaagccaaaaaccacccaaaagtctataatatgtatatatatgcctaagcctccatgcgatccgcctgcgcagcattaaagtcatcacgggcagtcgtgaacttgtccgtcacgacatcacagaggtccattagagtgtcgagacctttctcgagggcttcgacggcggtggtagtttctgtttgttcattcgttaatacaggtgatctttattctgacggaaaagaaggtaggagggcgggaagaacaaaccataagtctgaatacgaaggttcatcttcgtctcggaaggatgggggatggtgtaaccgcagaattcgacttcggggctgaacccgaggaaaactcgttagcaagatccaacataacagagaagagaggggtttgtaataaagtagagtatgtgtacgcacttcttcataatcgcataccgcagcgcattgcccagagtgtgaccctctccctcgaattggaacgaagctgcggtgtcggacgagccgagcaactatcccatccagcaggtattagcatacgcccggaagtgaatcatgtcccacagtgtatgtagtgtatacgtacaacaacaatgcgcttctcgtccagctctaggacatcggtctgctcttgctcttgaggcgcggaggcgtccagcatggactggtcttgttcttcggagtggacggaggcaggcattttgatcggattgtatgcagagattagatatcggttcctgggcattacggttagcgcattgtctggtatattgtcgttcgttcgaggtgtatactgagggggtgagtggtggtggtggtggttattcttaggaggggggagcggaggagagatgtacttagtggcgggacacgcgagtcgcgggtgcgggatatcttgatggaacagattccaaaggatagtatattcccagctagatgcgaatagaaaatcaaatggttcgtatacgtcaagtttcgcaaacaaccagatgcttaatgctcatgaggagaaaaaagcgaaaaacggtttatcgatatctcaccgccttcggaggaggagggcatatccttaccgcctgcttttttcggctgtagtatgctcagtcttgtactatttgctgtgctgctctgcgatgtatgtttgcctttggtttggatcttattaattctacataattgcgagttgctaactatctacggataaagacctgtctcttgcaagagctgcaagctcagctgtaggaaaactgacacacagcacatatcccatttaagcactctgcatggctaatatatccaacggcaggatacgtacatatatgccgtacagcgaacgctcttctcggccgtgtgcgacgctggatacgaagtagtagctactagtcaagtcaggttacttcagctatttacattaaatatagcatctggattgtcaaacatcgggcacacggtatgatctaccactatgcatacccttgtgcaactgtggcttgattttatttcccccttctctctgtcgggcttgggggggcttgtgtccttttctttgcagaattggattttgcttgcatatggtatctacattacggtgctactgtggttttctccggatggatggatggatactgcaggtaatcgaccgagaaggccactatctggctaatccttactggagatgagtcttatgtcgctagatttggtagtaatattagatgaatattattaagaaatgactttgcttgtgttgactagacggaggaaataaaatgctccggtgagctgggttcaacaggcaatcactcagttctataaatatgtatgccatggggagcaattaatgtccgcaccagggatattttagtgcaacgctgtcacctacagaaactcaactactaaagtagcagtactattgaaggtacggtgtaattgttcttaatattctacaatcaatagctcatttcgttagcacataggagcgatcagttaatcctggttaatcctccgtaggcaatagtaactgctataccacgcgaccgggaccaagctgcattctaagtacacactgataactacctactagttatttgctactattattgacaacaacttattgcgatcgaccagatgctatatcgcttgcctttggggggaggggcttgaagtgcacgcccactcttttttcccacatggaagaaccaatattagcaacagggccgtgcagaggcaacgccgttgagactagacccgggcttcaagaaggcttaacacggggcgttattattattgccgtctggcattcaatcaatcagccagcaccgacagtatttatgacacacactgtgatgatgcgccggtcagatacggcagagtaatcatagttgatattaaactattttcttggcgttgtagatagctaggctcgctactgcagatatggagcttcgggtgtatgtgagtagattactttgcagtaagtagtaactagtatgctcggattcggactcggagacggtcgtatgtagtggatgatgtcgtgatagatggggtgacgaaatggatggcgcgtacggaagaattgatctgacattgatgaggagaattcctgttctcatttgccgagtgacttgctgctttgccaatagtaggactgttctaccccatcgtttgagacatttataggcgagtgtgtactgtgtatattgaatatggagtatcctatcgggtcggttaactctcgaacaagcccttccttgcacatgggggcgttcaataaacgcttatttggcatatgcagggcagagtagaaggaactccgtgtgtattgacggaagataatggtggttctcgtttcgagacaacacccgataatctatctcgtactcttccggtgggataaaacacatacgtatccacaccgtgtacatgatagatggatagatggatatccacgaactcgggatcccagcttgccgagcaagccacacacgatcaatcgattcgaacatttacaccgacctcctggaaaaatctcagcagcttgacatgttaagttaggtagacccttgtgatgtgacaatccatggtaccactcagcaggtcaataattactggagacggcaaggccggacccataaactagtggttcatcagactggatggcaaggccgttccttaatcttatttgcaaggagcacacgtgggcccgccaggccgaggttaacttatacaaagtaggctaacgagttaaagtaaaaataagagaagatatgcgagggtgcagactgtattttttttttttctcacacattgcacaaacatttactttcatctggatagtatagacattgcttgccagcccgatggttggatagatattcgattgtccaagttcatactgttccccggcgatctaatatctagtagtccactccgtagtctcctagtcccctactaagccggatctcactagtcgtgatccccgggttaatgaggcggtcccgtttaatattaaaatgacttgcctcgtggagcgggaaatgaggggagaagagatcgtccctggtgattggctctcacaaacgggcttatccgcagatgatttcgagccttaaataggaaggtctgtaagtattcaggaagtaatccataatagcacctcccatcatcggtaccttggatcaggctgtcgaagatggatactaactatcgaaagtcgacaaataccttcatttggctgctgcaatgaaatttgtcagatccacatcccacccagccgtgtaagcaggccacgcattggatcggagtagaagagtacctgcaaagtatcagcactgcgactgtagcagggattgaaatgataatatgccacaactacagtagacgcaagatggagccctctgcgtgctttgacttttactaaaccttcatgaggactaacagacctctttttcctacccaccaggctgtcgggaagtggttccgcgcgttagttttaaatcttgtgaatgtattgggaactgatattaagaaggacggtgtatacggatttggctagatcactaccgagaagaatgggtgtggctgtttctactactggtgattgattgattgattgattgacttgaatagttagtagttctgttttgaagacagcatgttaattgagtttgactcagcagggaaaagtttgacaggtcccatgttttgcattgaggccttgtttgagtcaagctgccgtctgactcgagcaaaaaggccgggggcttgggttttggttgcacgagggctgggattaaaaccatccccaacagttgctgctactgttgctgctactgttacaccggtacggcatctctcggctatcaaggtaaggttaactgactaacttactagtaaactaagttagtcagttaattgtccagaattactccgcggcccagtctgtccgtcctgcactgcaaatctgattgagacaatggtgttgtcgcaggaagcgagctaatcgtctgaaagagagggattctcatttccgccccaggccgtgatcgaagggggcgggcagcgggctgtgttgtggaaagtcgatcttcattgttcccaatagttcgcaggttcatgtgcttgaaatgagcctgcgaaattgaccatgaaagttgaatggaaggaggcatgggaaaaattctgccttacagtagttcggtcgctcgggcccctgggatgtcgcaaggtaagcagtgccggacgatcatgtctagaattttaccttcgaggcggatgtgtgcgggtgagcaaggtaggtatcttcaccttctcacctcttctacaccctacatacatacataccttattacgcttcttagtatgtatctacagttgggtgctgttactcctactaatctgggagtagcgaccaaggaaagtcaactgatttccagtggatgacccggctgggcgcggagtatgacggaaatcccagtcctgatggaagaggctgcgatagaagcccgtgtcggatcattttagtcttactcatattgtagaaagttacttttgttgggggcagaaatgagtgtcgttgataatgtagtcagacttgacgatctgattatcatgcaatgtgtaatgtgttattgttgttgctgttgctgttgctgctgccgttgttatagtaagatgatgataatgataataataataattctcattattatccctttttttgttttgttctcctacccgaacagttggtcttcccggtatggagcctttttgaccaggatattcatccattcatgcgactgttggcttgtctcgggcatgtcacaacgcgacacccacgagaagaacgagggccgatcgtcgtcgtcgtcggactgtgccgcgggatgatcgatcgatgcatcgtggaagagtcctggttgcctaccttgtttcttctttttgcttatcatcattaccaaggttagcaaggggagccctaccaagaaatccatctacttccatccatggtgagcatttaaacgttgatctcgccctcttctcccctccgtcctccgtgcctttcattgttcgggctggatccgtcggtcttttgaaagctgcttccgcccccattccagagctcaacctcgaccctctcccccccgaagaccatcactattagccgcctccgctaccgagctctcaaatccgcgcgcgctttcgtccgatctcgccctaccaccctataattccagcgcttgtcagagaaagcttgatactccatctgctccaggctgtgagaccttgggtggcacagtccttagtaccgtacaggaacacgctatatagtctgtggctgtgtgagacagctcccgagggggaattcctttttaccttttgtctgtcgccagcctatatcggttcaactgctgcaccgtcactttgatttgactgtttcccctggtcagctgtgtgcattcgccaaggagttttcccgctcctttgtgtcctgtcgaactcgtcacccttcgttgtcattatgtcgaccgcggttgcgcctgcccagggctgctccgctcacatctccgcgtatgacccgcgatatcagtccgaaaaattgcccaacactggcgcctgcgtcttcgggtaaccagacgagtaccacgccgccgcgcccatccggtgtctctcgggatgcgtcttcggccaaaagctctcctgcaggaaagaaaccgacctcaccttcgtaagtattctgaccaacagtcgctagctgaatcgcccatgcagattgctgacctttcagcagatcacaggccggatccactgcgagtcgagtcatcgtgaaaaaggaacccccatcctcccctgcaatgcagtctcatacaagacctcgccctcgcagattagatctgtctagtagccttccgaactctgggggcttgtccgctcggcctcctggtggccctatgactgcgagagagggcgtcaacatgcaagaggtcgggatcgcttgcctgtccccaggatttcaaacacatgatcctgtgatgcgggagcagctgcaacggagcttatcggttcgggatcagcagcgctcaataatcgaatcgcgtttacagaagtccgccaaggatgacgggcccgacggaataaagccgtctgaatcattcggcctccccagggtcggtgcatcgaagagaagacccccgcctggcctctccatcgtgcccccgtcagcagcccaatttgctagtgaacgtgtcatccaatctgcgccattgaatcagaccttcacgggccgaaatgaagcgcagcccttgacacgtcatgtcgttaaccaaagtccgactctggggtccacatctcacatccaccatctccctgctacacaaacaaccaaccgcttgcccccgctgtctgatgtctttggaaatgaggcgttgggccgcgatcgcgaggcaaaccggggaatgtattaccccagcgcgacagctgccaacccgcctcaatcgaacaatctgccccccattccctcccctcgcatctcccgggatgccgctcaacctcccaagcgccccagggagtatcgttccgccgaggaagctgtccaggaactgtcaggtgggcgcgaggagcttctgccgcgcattgtacattacggcggccaccaacccccaactccaccatctccccgtgtggctaacggaccaccaaaatctggagtgcctcactcggatgctacgcccatggcgaatgcgcaccccccacaaccatcattgtacccgtccgagggtactgctcgtcgccgctcgagaaatgagtacgaacatgagcacggcagcccgcccttgggccacggccccgacccacattatcgccctaacccagccttggcctctggcgcaagtgccacttatggcccatttggggctgggagagactcccccgaaacccagcgcagaaagaaggaagaattccttagtctctgcgcacgtgcctgggacctattccattcttaatccatggtcaagttgcttagggtctccctacgtgacctgatttggcccgtttctatgaatgcattcccaaataccgtcaactttccctcatgcactattcgaagtggtcagcacttgagtttatggataggcacgacctagcagaaggtgcttgcttggtagcaatcacccacggctgaactgcaggcccacaaaaacagcagtttctacgtgtggagggagtgtatctgaagaatagtaattattctagacatgatgcatatgccaaactacacgactacctatatgaaccgcatgaacagtcgctctttgaaaagaacggaagggtggatcccgtcccttcaatatcctcatcatccctttttaccttttatgcatcttataccatgttgggccagacgccttcatcgtttgccattgatttcagtgtttgcttctattcgatcatttttcaatctcttctctcttatcgctctttttttttaccccccttcaaagttccacttgaggggaacttgctttattctggacatgaggcgttactttgttatgggtttaaagatcatgttcttcgaagaatcatgtctatattgtttcgaggacctcagatttcggtgatccttgcgtcattgacttatggcttgttgcgataccatttgattgtttgtttgtgcttacgcgtctgattatcttggtacagcaatagttattggatgttggttgttcgccatctggcattgataatatgttcttcattttctccctctggctaagctgcaactacgcctggaaggaataagtcggttttggataatgataagtaataccgtgtctatataacctcttccggcctgtcggcttggacattatattctggagaatttcgtagaaggaaaatgcctatgcagttgcgaactatatacaataacatgagccaggcgccgaaatcagacagcaagtcccaacatctatgcaactctgcggcgtttccagccgccaccttccaccgccactcggcgcatcgtcgccagccaaggctctccgctccatgggcatctcctttctttccttggcggcagtcttcttgcgcttcctctcgagtgccttggtgcggtccttggagttcatattctcgtacttcttgagcagcacctgcttcttcaggtccgacttcttcaagaagtacgggttgctcttctttccttcgcggatgagctgtttctccttcttcttatgctccgctaagatctccttctcgcgtttcctattctccatcgctcgaagacggtcttgagtcgaccgaatcgtacgcttcagagcttctttctgttcttggttcttcgtcttggcgtattgttccttcaactgcttcagttcgtcccggcgatactcgtccaagaatgcgtaagcgttgctcgttccttgagggtttccgcgaccaccctggctcaggacagtcgggtcaaaacgggggtctcgcgacttgggtacacttggcggctcaatgatggtccgtttgcgggagacggcatgtttggaggattgtacggccggcgcatgcttggaggaacgagagagcttttccgaatccttatttttcgccagcgcttggcgtttctgttcgcgtgcctcttgaatccgcgcccgaatgtcgtctaagggggaaggagcggcaggctcgtcttctgtccgggaggccttggacgaccgctttgatttgggtcctatagatgcttgcgctttcgccaatgcgccgaacgagatactgcttagtgaggcttgaacgtcgtcctgggcatcatcattgtcgtcttcgtcatcttcgtcgtcgtcatcgtcgtcatcgtcgtcatcatccatatcttccgggtcgccttgagactgtgagatagtcagcatgttgcaatgtctatccaaacgaggggaaactaaccacatcgtcgtcgtcgtcttcgtctagggaaccatcactgccactttctgagcctgactcgtcagagcggagatcgtcgctcgcctgatccgagccagactggtcagagtaaagctcctcgtcgtcctgagcgacagctcgcacacggcgattcagtaggtctgagatagccatttgcggatcataaatgggggatgtacaaccgtaaatagtccaccccaagttgagatgaaaacctaagctggccgggcggtgagatcggcggccgaaaaaaatgaggccgttctgcccttcgtagaaggcggcgagcagatcgtccccaccttgattggccagacctcccgataagtagtcactttttctgcctccgcatatcttctatctttcttttatcgttggctgctcgcatcctctttactctccctccagtgtcgcggcggattcctccttcggtcgttcgtctgccaggaatcttcccttcatgttgcgagtacgccaatgctgcttcttccctcgtttgcctctacttgctataaagccccgccccgcccccatagttacctctcctgatcgcaagtttcaaagtggggtgtccaaggtgtgtacttttggctttcatttttggggtacttgtatagctgacacctttaacaggctgatctgggaacactcaacgctcattgtactcctttcactccccgcacatgctttcacatatcctcgagttcaccccgagtttttgtccacaacaatcggtccgttaagcccgacatggagtcagcaaacgcaccggcattcgatgcctctagtatagacagtcgcctttgtcatgatggctccaattcttccgtagtgggagacgataagcctgcatggagaccgtataaaggccgttgggctcgtcagaaaatgaggaataccaagcgcaacagcacagaaaatccggacacgacggctccaggaaatgctcccccggctgctcgcccgcggcaaaagctaccacgacggagcaaacagttagccgaaaagaacattcgcgaagagatgcaatctcaagcatcacagtctgccggttcagcgtcctatgtaccaggtcaaccaccccagaacagctttggggcgtttgacaacatcaatttggctgctatggttcccccgttccagaatggcatggctgcgccaaacgaaaatgttccagggtttcaacagcccttttggcagctcccatgggagcaacagcaattgctattccatgctcctgtgggtgaatccactaacccttctttcggtttccctccgttgaatgacatgggtgcgttccctggtggattacctcccatgtttccgcctgcgttcatgaactttgcgtcaacgaatccattgatggcaatgccaccgttcggacccatggccttccaagcagctggctctgctggaatcaatacccgcaatatgtccagtcaggtcccatcaccacgcccgggttcttcatccagggcacgcgctagtcctcgacctcgttccaaaaggttcgactccccgacaccacctaaaagagctatgccaacaccggcctacctcgagcagtcgtcaaagccagccaaacggaactcctggtcacaacctctactagtcatcctggatttgaatggcacgctcgtccaccggcctgaccggtacatgccacctcggtttaagagaagagcgggactggacatcttcatacagacgttgatgcagaaatacaaagtcatgatatggtcgagtgcccgacctcccaccgtagacggcatctgccgccaactcttcatcaatgacagccggacgcaaatcgtcgccgaatggcaccgcgagcacttcaatctcactccgcagcaatacgatgccaaaatccaggtctacaaaaccctcagtaccgtatgggccgacgaaaaggtccaagcatcataccccaaccccaaagacctaggctcgtccgtgcctgcaaccttccaaaagacccgctgggaccaaaccaacaccatcttaatcgacgacacccgcctcaaagcaagcagcgaaccaagcaatctcctcgaaatccccaccttcgacggatcctccggcgccgaagacgccgccacattaaccaaggtcctccaaatgctcgaggagctatccttacacgacgacgtcagccaagtcctccacaaatggtacaactcgatccccaaaacaggcaacctctgcctggacatcaagctccaagaagaccccgaagcccaacatcaactccaaacccaatgctacaacggccccctcaccccaacggagatcgccgaagcacgcaaacagcgccgcaaagcccgcaagcgtgaaaaggtcgccgagaaagccagagcccgtcagatccagaagcaagaacagcgtttagccaaacagtacccaccccctcccacatataccccaggggtcgtcgcctcatctactgtcgatgagacgaatactgtcacaccacgtacagatctctcttcctccaactcattccctcctcattctccatcatcaccttcatctgactcgacaccgggtggcactgctataccaacaggatatgatgtcaatgacaaggtcaaaaggactttgagggttgctggtgatgatgatgcgagtgatcgttccccgtcgcctgctgcctcaactcaatctgagaattatctcttggatcggttggaggagtcattgaagacgggttgaggggcagagtgttcctttctggttttgtgtcctttctcgtttggtgtggatattgtattctgtattgcgggaggtgggtgttgtacatgatatggtatggtgtatatgtggtaggagtcagacagtcagggctatgttgttaaagaacaaagcggctgggctggtaccagctggtttactttacgtgtgcacagtgaatttctcatgaacaggctattatattatagaatacgatatggcatatagagagagtactataccatacaattactacaacaatgatttactgcggatagaaatatcatgatcatggaaagcacaaagtgctagtgggtttgtttttgactagctactgctatggtccatatcaatcgtaagcgtggcattacgcgtgaaataaacaagaaaaagttttcttttggaaggagtcgacgaagaatgaaaacacgtaaaccgttccatcatgggcagcgtggatatgtaaaaaagggcgggggtaaataaacccaagtggggaaaagctatcagatgggatagaagtggaccggacgggaaatagcgccctgaacatactatccccacgaaagctctcccacactccggttgaggagaaagagacggaggttatttaaaggtcgagtttcatctcagacgactacccaacgagagagaagaagggaaaatttgggatatcatcatcatgaattggctacgtctaacgcaccagcttatttgaagacgtggccgtcagcgaaggggtactccttgccgtcaatgacgacggggacatcccaagcccactggtcctcgatgagcttgcggtcctcggggttggtgtggtcgagcttgcggaactcgtagctctcccagtcggggccgacctcgaaagcgggctgggagtcctggccgcggaccaggaagacaccctggatgacacagtcgtagttggcaccgtagacggcctgggcaccgaagaggtacttgcgggaagcctcaagacgggcgtggaaaccaccgatcaggttgttggccatgaaggtaagcttcagctcgttgttgtacttgtagttaacagaccagagggagtactcctcgggcttgtagttctgccagaaccagggcagagcaacggggcgggtgtcctcgttggagtactggcgcttccactcgtcaaggacgaactcggagcggccaagagcctcaagggggtgcttgggcttcttctcctcagcgggcttgggctcagcgggggcagcggcagcgggggcagcctccttcttgggcttctcctccttcttggggggagtgtacttgatgcactcctcgacgaagacggggttctcgaagacagccttgaaggcgggctggttgacgatggtcttgtaccagcgggtgatggcaacgttctcgtcacggaacttcttgtccaggacggtagcgaaggcacgggtgaggagagcggcagtgaagtaatcagccagggagatgcgctcgccaacaaggaaggtgttggcagtgaggtaggtgttgagaacgccagcgttcttcagagcagccttggaagcatcctcgacgttcttcttgttgtagccgtcaagacccaacagagggcggaaccaggcaccgaagcgggggaggagctcggagttggcgaaggacaaccaacgaaggatggaagcgtagtcctgcttggtcttacccaagagggtggtcttctcgttctgggaggtcacttttattcgagtcagcatgagttgtccaaccaaatgacaattgcgtgatcatcaaataatcaaaacgaaatttcttcacccccaaagtggggtaaagagatggtttttttcagagtcaaacgttatcaacattatttttattattaccagttctgacagggataacttgaaataaaatactcatcataaaacaagcaaacgagattgcaacgcgcagggcgtattcagggagaacgtaccgtagacagcgatggcaatgacctcagacagagtgtagccgttggcaccctcgaaggcggggatcttgccgagggggctgatcttggtgtactcagcagactggttgaaagaggcaccagagttgggctcagtcttgaccagctcaagctcaacgtcgttggccttagccgcgacgaggcaggcaatggtgcgaccgttctcctatggagtctattagccaggtgttctcagcgacagcaataggaagctaatctaaaccctgtgaaggggaagaacagcttcctgaacacatgcagaaacacatacagggagaccgtagagctttccgaaggccattgtgaaggatgtgtgggaggaagatgaggagggaggagaagaagaagagaaaaaaagggagagaggaggaggggaaaaagagggagaaaaaaggcggcggcagcttgtcgaggggctcgaaacaaatttgtgcgaatcagaccgcttcggcgccggagcaacctttgctgccgggcacgtgatctctccggcgaaaaacctcaggatagcaagaagttgaaggttccggcgaatcttgtcggttgggtccgttggtgttcttcgtcctctttctcccttccccaatcgccctttttctcacctcacatccctcccaggcccctcctttgccagccggtctgcagcatcatggcctggcaaagccccaatggccttgtgcacgccatgcactccatccgtcgaactgctcaattgcggccttttgtccagcgctccgtgatctccgcatcatccccggtctcctctccctccacgccggctctcctccagcaatacaagaatgcccgcagctatgcgacagaactacaacccgttgctgctccccccattgagttctccaaattccagatccagcctgcccgcattatccccgtgtcgccggcctacttctccggcagccccaagttcttcgaccacatgctgaagctggaagcccttctggccaagtatgccgcactacccacggtgtctcctagcgaagcccccagaatggcctggttcaagctgcttcagttccgtgatgccgtgggcgagcccgtcccgaccaagaagtacaagggcctcatcaagctcctgcagcgtctcaaccgcatcgaccccaaggttgccccggaggaggttcgtacggctctcaacttcttccttcgtccgggtaatccgtatggaaacaagcccgcccccaggacggtggatgaacagggcaaggcccgtggtaagggcaagcgcaaggcgtcctcggcggtggtgcagctggtcgagggtgagggtgaagtgttggtgaacggaaagacgctgaacgaggctttccctcgtctacatgaccgtgagagtgctgtctggcctcttcggtgtacgtcacggctcgacaagtataacgtgtgggctaccgttcgcggtggaggagtgaccggtcaggcggaggctattacattggctgttgcacgggctctgctggttcacgaacctgctcttaagcctatcctgcggaagggtacgtatctccgactcccgacgaattggttggtagtagtggagcgaattgctgaccgatttattttcttacagctggtgtggttaccgtggatgcccgtcgtgtggagagaaagaagcccggtcatgtcaaggcccgcaagatgcccacttgggtcaagcggtgaaagcacacctgcctaccttacgcccagcttcttcttttctccctctgtctttttacttatccctccctctctggcttttggagggattgtttctctacctgtcttctgttttccccttttcccctttaatttccttggttgtattattccacttggccttgtgattctcgacgaaagtatatcctgtattgcaagcatctcaacctggtgtcacgaggattcgtttcaggacacgacactgcatgttctcggcgacaagcatgtaactattggcgttgaacaattgaaccgaaactatagtgtagaccatctgtgcgacgggggtgttgagcataattggacgaggtagaaatgccccgttgactaagaggattatccgagggtgacttgtttgtccaacagtacttgggatttgtggtcaatgagcatgatctctttcctccgaccgtcttgtcacccaccccctttccagacaaagggaggtttcggggggaggaagggggggaagttgttggacactaggacggccagactcgtggtcgatataggggaactgtaaaaaaggggacataacgcgaccaagatgtacataatctactgtcttagtaggcgcaaacaccgttaacctttaagaaacgggcaccgaagatcattttaccagaatgaacgtttcaggctagtcagtagtccctcctagcaactagccagactcatgattgcctagataggttgcgggattgaatccagcctgataatagtagcgaccagaatctctcgttacacagggagccccaagcggtcggtagtgtcgaacgccaggacgcgactatccataacgtggcgccccattgatcggggactgaaaagaaggaaaggtgatgaaccggaaggtactctcggccttccacttcctttcccttccttacccccctatagagaaagaaaagacgggctggaacctgctggtggtaacacagagagcgaagcgaggttccagatgaatgaaatgagccttttcttttggtcttttcttactcccgggacccggacgacgcgataggaaggtatatacggccggatctttctcatcaaatgggtgtggttggttgtgtcgtcatccgttcgattgggaattccctccatcatgattggggcaagcattcatctgcctgctgctgttgtggtcatggccagcgtcatcttacacctttgtgtctcgggaactcatgggatcctggaagtgacgttattggacgatgcgatcgagatctaaaactagagtattcgtcaggctgtggcggagaaggggagcagccctgtagttggtcggccaattggacaagttggaagcagcattgttttacgcggacctatggggtgagaaaggaaaagagctgccttggtgatgctgatggtaatcgactgatgactatatcggagaaatggggtagacaaaattaagggaagtggtcttgtgtgtggatatgagcccaccgccgatgcgcaaatcaggtggagattatagtcccacacataatggcattatagcctctccgcggataggtttgataattgggagtcatgcagtacgtttggtgggttcattgtattcattaaacaccagaccatgccagctctgccagtgagagtgtttaaaattcgtgcgcatgcagttgtgtagacaagcttccgattgataccgaagagattgtatctccagatatcgccgaaattagcgtcgtatagagcgctttactatactgttgcacttgcctgcttggtcgtagctccctgagccagcggctcagagggataatgacaggacactcggatccccggctggcacgaagagcagctgtcagaacaagcacgaggcaagcccatcctatgtcgcctgttccattgtcctgggcttgacgatcatccttatgaatagccactaaagggtgcgatggtcgactgatgactgcgatcctgaaatctagtgtgaaagtggtgaggctggacccgcctcactttcatacccttaaaccttggaaaccttggaaaccatgtcctatgagctccgtatatcgctcaagatgactcggacccatgatttggaatctcttctcgtggagacgccgtactttcggcgcgtgcgtggggatcacggcccccaggtctagctggagtttctgacaggccctaaaagcggcgccggctcttcggacgccgttctagtggcacgccgggcttcaccctgtcacgccctaccatttagcgctccgctggtgctagtagtaatgcgaacattccaaaatctcatgacagaaaacaattgggaaactggagaatagaatacatctaacccaaaataagaaaaggaaatggaattaagaccagatcccggtctccttgcgctgcagactaaagttagcttgctccaatcgcagtgctgcagatcccccctgttgctccgacaagcgtggcctcgattggtcgctgaaggtgcatgaccttcccagcaggccggaaggtgtgcgacccggcagcttagccaggcacggcacgatcattgacttcatccatcgattgagcgacttcactggctgtatggagatccttgattgggatcggaccaagcagaagtctgcaacaatcgacagaaagtcctgcgaaacctggaccgtgctgggaggtggtagctggatggctgcatgatgcaaaggccactactattttcccgacccggtactccatactaggactattctgctgggacatcacaattcgctgcgtttaaacattttggtacacaataatgcactgatcgatccaccatccagctccccggtgtcgtctaatcccagaaagcggttcttcccggggtcctaagccgatcttcgtaaagctcagtggccatggcggcgggtttccgtggaaccggaccgcgaaagtagtacttttactgcttcttgccttgttctgggtgttccttcggctgcttccaatttactttttcttatccttttcatacagatgggcgtagatcttcccccggcttgcaaacccgatccagaagactgggacacggttcggtgcatggaccagaagacgatcacccaaatagcgtttcggaagggcttaaagttgactttgaagtctgttcggggaagtcggcccagcaagtgggaatcaatcaattaatcaatcgatccattgattgtggagcgagtagacggatccccgaatttggaatgaggactaggtgtgtctcagtagtgttgaagttcaaaagctgaggttagcctggacggctttagtccctgactagtagatactagagagtacttagaggatccatacctgggccagtacaatatgtagttatgggccgtcccatcttggagcaattaaccttaatcacatcctctaggaggcaatcagagggagagcggacagtgagacgagggagtgttgacaaggtgcatgaacggatagtgtgatatggggatgtagataatgctgagtcgggttcaagcaggtacttttcagccccgaatagccccgcgcgcctcgtgtctgactgatcttcagcacgattgcaaagatccttggctcccgacacttttcttttgttttatttttcaatttttcgtttcgtaggaatgcgatggatctgaggcggctcctgtgggggccaccatcgtaactatgaagtgatcctagtgatcctcctgtctgccgcccacacgctccacacgctctctctctctctctctctctctctctctctctctctctctctctctctctctctctctctctctctctctctctctctctcttactcttttgtctcagcaccacccaccatctgtaaacttctcgcatcctttggtcatcgtcccggtggattggtccgcaaaaggaatatgagctgatcaattagttcagcagatggagccattctaggttcgcaccagtgactgatacccgtttcgggacgtagtgcgtcccatttggatggattaatcagtttccttgcggcggtgggggttttttttaagggaaggaagaagagccggaggggggattcaaggaacacgaagatgaacaatgaaggaaagggggtggtagaaattaaccatgcaaacaatcatgctttgtgttttcttctttttttcttcttcgtttccttttgttactgttctgttgctgctgctgtcgttgtcaggtattgaattaggctcagcctaccaatctatttgtgaccaaaacacacaaacatccccctacattttaacctaaacaattgaattaaatatggcaagatacaaattaataaacccccatgaattaagacagagaattataatctatttgtttataaaattcaaatgtcatccattctccacttttattcggagaaataaaataatagaataaaaaaaataaaaataaaaataaaaaaaagccactgcagggaaaatggcaggagggaaaatgaagaaaaagaagaaaaagaaaagaaaaagcctcctgcatctggtttgattgctggtttagtctctgcgttccctcatttctttttccttcatcccagggattttttccatctcgatgggcttcgtttgtttttcgccctcgtttctcgcgctttctagtcattgctgatgtcttattcgtttctttcttttttttcgggtctgcaagtccctcggatgggtccattatgcgcgcgtgaaggagggtctctcagcctgtctcttgggctgtccggtgcccactgggggagaagcgacaaaaaggcatgactgactgactgagtgactgactgactcggactgaacctgattcggcctgatctgagttgagctgacccgacttgatactggcacctttttcttctgtttcatggtttcctgctgtccatcccgactaacctgatcgaccggccccagaggctttccaataattccctgcggatcttccggcctcttgctgtcccatcagcctggttgctcgatgctataagtaatccgtgcatcccaatcttctcccggtccgctggtcccccacttctcccctcctcacttggcctcatccatcttcttctttcgtcgtcatcgtcctcgtcctcgtcctcgtcttcttcttctccttcctcctcttttgtactcttgagcatttggggtcagaagatcccaagttgttcccagtcagcaccggtcttcaactcagatctggagcataagcatatcccaagtcccgctcttgtcgaccccactaggcccctagttcctggcatcatcctaccagtcttgattctcgtcttgtggactattctatatcggccttttcttcctctctctctccgagtgggttagaaataatacccctcctttctcttgtcctccgccccgccatcccagtcttctacatagatcgagccccgggttgtgcgattcaccccaaatccagggccgagctatcgtctagaacagatttctggcttttctacaaggtgcgcaaacatctagagtaaacaactatcccctactgctacacatctgcactcatgtggtttggcgacgactgatcggtgggtgactatctagatcgcgtgcgctggttgtacccgcgtccctgcgctgaagtgaaaccgtgagaccctccgcgcgcttacctgcgattcttgttggcttggatctcaattccctgctagcaggaaaagccaccgagcgaataagctagggcatcccacctcctacctcagaaacagccgatcgctccctcccgccaagctggaatcctacgtgagcccgccgctctccccactcgcgcattggtctctcgacctcgatccagtgcgtgggggtatggatggcgagatccggcgcatgaagcagcatgatcctcatacccgctttgcgactagagctggcatgtcccgccgcgcggcggatcgcttcagacagactggggtgccatccgcacggggagatccctctcaggctaccgggcgtcctcgagtgcccacgtacctggactatggatacaccgacacttcctttcaaggcggttcgctacagggggatgagttgcaatcatacacgccaacgttgcgcgaccaacagcgccagcatcagccggtacaccagccgttagctccttatgactccgagatggtatacaacctcagccagcaggacccgggacaagccccgtacgagctcgtcccaccatacccgtcacggcaatctgcagcgatggaagcactgtctagtcagtttggtgttccacaatatttcccgccaaatgaaccgacggccacaggggttccggccatgggtccgccctacctgtcatcgcagctccctttgtccgcatataaccaagccggcgccattggacgctcgagcgctccgcacgtctttcccgcagctatggccgaactgactccggtggaagtgtctggacgtttggagcagcctccgtcgccgtcgcagcaacaacagcagcaacaacacttacaaacaccgtcccgagtggggtccgagtcgactggcctgaaggaagcctttgcccagttccaacgagcattgcgagagacatttgatagtacgcgcgccggccgattggtagaggctagtagatcactcttggaaatctccgagtggcttgtgactaatgcgcgggagctcggtatgtccccttagcgttctcaccaattcccacgccaatgggtttcttacccaccctcccccctctttagctcctggcccggttactacctgcatgtacctaaaaatgcatggtacttgattcgcattcgcttgacgcacacagcgagaccggggtttgagcgactagattatgaaccttaaggctaattcggctctatcattaggtatcctccgggatgatcaaatgctacatgcggatcgactgcaaatttggaatgatttcaatatttgttggctagcggtatgccagaagcagaaagatctggctcaggaactgctgcaaaccggtcgccagccgccccaaactagtctcctcagtggcgacgcgatggacaatatgggcaaagagctgatccagttctgcgatcggatggagccccatgggctagttgattaccagatggggatttgggaggaggagattctctccagtgagttgctctttaggaagatttcttcccattataccgtaaagggtttctaacgcgcttgacagtcatgggccagtgtctggatattgtcgaaggccgaccggacgtctttcgctcccaagccgcttcgcgatgacgggcattgaagccttaacctggggccgcgcataaccgggttggatgctggagggacgcctggcgcagactcggctggatcgtacttttgtgatggtggcgggcttagggcccctaacgcagggactagtttagtctagtggatgggagcaaagccaacccgacgcccagcgccggactatcgattgatagatcgcggcgtccgagtaagcctcgtcacgactcgtggctcacgacttttccttggtctcctttttcctttttcgtttccttgaccaggccgtcggtaacccccaaattcctctttccacagttttggatacgtcgggcgtgttcaggcaccgcccccactccatgctggcccctcgtgtcagctcatttcccgggtcaggattccgccctattggcaggagagaatctgggtatgccagctgagggaaagagaacgggatgggaaaaaaaaaaacaaaaacaaaaattggaaaaaaaaaagttgagaaacaacaggacgctacttgttctccagtcggcgtttgaagggttatgaacactccacatctttgtttcgcatttagggagcaaagatctggtcgggcgcaatggggtttcaggagatagacctgaacggaggcctgaactgatttacttggttgggatataagtcgttggcggctgtgtgtgacgctatgtggtgatggcttaagtgcggctgaactgaaccagatcctgcggccagaaatctttcgttccaccttcggtcaaactccgagcagtgatggattcatgcccgacaatgaaggagacacaggccttgaccggggctgatgttctcgattgttctactgtctcatcgagtgttcagcaccaccccgttcgggggcaacatgaaggatcgggcagatgggattcaattccttgtacgatattatcctttttctcctttgtgtttgatttcctttgtaatagtttaggatttaagatacccaacttagtagttataataaacttagtattaggacttcatcagcagtctagtctagtctagttcgcagcccaaccatcctaccaaacacctgagaacaaacaggacagggatcagagaatggaaaggaaaagtaagattagatcctgcagacgcacccagaaaacaagataccggcatttacttcacacatgcacagcggatttacatatgcagcatgagatcaacatgtatgtatccatgcaaggtacttcttccgtcctttcgttcatggaaacgtcaagaaataatacttgtcataagttcacaaggatccggcccagagatcagggaatagttgcagtagtgggaaactttaaggccagggtagatattatacatacatgtacttttgttttctttagggtggagtggagtgggggagatcgggcagtattggtgggtattttatgataaggagaaatgggatgggttgcccggttgggcaggagtgagattatagtgttgcttcgatagtactataggaagtagtaaatatgttatggtgctatggtagtattggggtactcgtatggggatttgaaaacagtttaagttgagtgaatagtatgtatgttcaattgattatactaaaaataaaatgattccgaagtacgatttactagatgaatgatctttttgggcatcagtaattattgttaatatacgatgatctgacagggagtcaatatgggttttagtagaagagaaaggaggtgaagaccatgatgtatctctatttactgtatctttgtagggtgagagatatataataggtgaaggaaataaagagatctgcttgacaatctggtaagtgatgtatgttagtatcgagagctgtggatagcccagatacactaactatatctcttgtacttactatccccatgactctgagactatattgtagaataatattgcctgttacttctatttactcgattagcatagtgaagatgaaggtagaataatgctttcaagatggcatgtatttcactcattcatttgctacaaatcgaataatcccgaaggctatatctatcttcaagatatacaccaaaaagtatcaaggtggtggtaatggcaattgggctggtttagttgctgttctcaccataccaggaagctgcatactcggccaacttctgtaatgcaatattcatactacggccagagtaagcaaccttcacagtggttctccctgtacgactttcaaccatataagagaactttgtccctagaacaggatcaacgatagggtcccacagcagctcacgaaaatataacgttccatatcgcccccgcgtcgtatatccgcttagttgacttacagaaatttcggtcagtgatgaaaattcggaaagggtcctgaaaatggccggccaccccccaaaatcgattttgaaaaagctgaagtgtattttgaccaaggtctgcttggaggagaacagaaacctgatcaaatcctggtctgagtccacgcagccacaaatcagatccggctcttgtagtcttaggggaggccgtatcatcagagacaagtcaaacataagaggcgccgagcattcgccgaaagaaaaatcaattgtcagtcgttttaggcgcggcttcgcatgatgtatgagatgcaccacaaaatcagcctcgtcttcttcctccactttgaatctaaacgtgagggtttccagactagaacagcatgtagtaatgaacttcggatcttgaaggaggctgctgtggacgcgggacaagtcgagctggtccaccgaaatgatatttggccgtttgaacaagatgcttagctctcgtattggacgctctattgcaataacaatgctgagcaggattgtaattgcatcgttaggggttgttcgatcgaatgggtcgggatcaacgggcgtgtcccacttgtacagacgaaatttctggcaattcactaggcgcagtaacacatcttgccaccgttgaatagattcttgtgggataacaaggagtccagactggtgatgttcccacgtaagtcccgatcctatgatatcctgttctgtgccgtcaatattcgacgtttggataaaggggcacagtcgttgattccgcgataatgtgtctagcttttgtagcgatgccagagacaggtctgtcgttatgttttcgagatacttgcaaaatcgaggaaaggagcagtcgtatatggttttgcaggtgagacggaaagaacataaggctgagcagtctaagcaagcgcttattaaaagtaagagttcaggtggcagggagcaaaagggcgaataattggacatcgacggactcatgatgactgctttgagggaagagaggaagagttcggtgcttcagcaaggctgggggataactcagtaagtttgtatactaccagctaacttatagttatggcaaaggacggagaacatccccgcattctagcttacatcagcagagccaggggacttttttctatttgagaattgggcttagtagcgttattgctggactgttagtactttcatcatctctatgcagaagaaggtcctctaggcttatggctggtcaaaatttcggtctccagaagagatagtatgggatatcccgtagacctcttgtgggcacatacgtacattcaacattcgtaggcatatgccagacgcgaatctacagagtaaatgatattacttcgatttatgcggctgggatcaacttataatggcctgctttcctctaaccgaagaggcaggcgcacctgaactgcacctttttgagggccgcgatttcccaatctagcctggtagtaaacactttaccacatcccgttagcgtgaatcctcctctagatagtcccattcttgctcactcagcgacacaggcactctcgttgatacctccatcctgacaatgtcgatatgcgggatcctcaatcctcgaagaaggatagacaagttactacgtcgacgaatgagctcaaagagagtagttcgcgtctgaaccggtcggggaaatcccgaataagacattgggcccccaaagtgaagactggttgtatgacatgccggtaggcttcataactctgccgctggaacatggagtcgttgacgcaggcagaatccggagagtgaaatgtgacgagacaaaacccgcgttagtactcttccatgactgattatagcaaagatactattatagtccgggctgctgacggttatagctcggtagttgccagcgatgctcttccaccggaagaagatgcgatggctacaatttgatcccccaaaagccgcccaccccggccctcggtctgattcaaatgccttcctattgggagctagtgtcaggcgaccgtgtagaaactgagagttttcggttctttcactcagtcactacgcccaatttggctggcttcttcgaccagggccgctgggctcgcagattgctccaaatgtcgcatcagtacccagttctgtggcatgccatgaccgcggtggcctgcattcaccgagacttcatgaccaacaccacacctattaccgtctcacggtcgcaggatagcctccaggtgaggcttgcgttgcaacagtggaacaagtccattcaaagactacaagaactgctgtcagaacgggttttgaccaaatttgacagactggtcatccttagtgtttgtatcttattcattaccatggcgagcttgcagggccgccagtggcaggctttcgtgcacatcaacagcggactgaaactaatttatcagtggaatttcgcggaccgaggcaaaagccagagagatgaggatttagatctggatgtgttgcttgtcttgttcacccaactggactcgcaagcgcgcccctaccttcctagcctttcgaatagccttcactggacagacaagcagattattttgtcgtcgtctaccatccccttcaagactttgctggaagcgtgtgttgctttggaggtgcattttaacagcatgatgcagatcttcacaagcaattccatatacatcaatggtccggatgctgggattcagatcaagaaacagcagtgccttattgatcttactgaatgggatgccaggctcgacaaatatcttgaaacgacaccacatccagaagatgggaaggctttgaaacttctctacgcccggcgtagactcgcacaagtggctctgtctatggacctgacaaaaggcgaactagctcacgacgacttcgtcgaggactacgcatatatgctcgagttgatgggctacattctagaagaccccatgaattccttagacagccagcctgggaatatagatcggccacaaagaatgagcttccgcctagagacgatcacgacggagccattattcctgattgcactccgctgtcgcgaacccacgatcaggcggcaggcgatccgtctactcagacagtacccgcggcgcgaaggcatctgcgagggcatggcagccctgaagattgcggagcgagtgatggaaattgaagaagaatgtttgaccagtcctgaattcgcttgcgctcatagaaagtggatatgtgagaaccaccgggtaacttggctacaggtcttcctggttcatgatcggcaggcgcggactgtgatgcacactcgggaggatttgctgcacggtcgacccggaagagagattctgacgacttattggtgattttatttggtgtagaaatatgtatatagatagacggcatgctgcacaggctacctgctatgagttatgaggaagatggcagggatgtatatacaatttcagatccaccaatgctgcagagcagtaattagatattacttactataataaatgaacgattcgtagcgacgatcatacaaacactgtattatttcaaagcaacatatcaagattacgttattaccgatgatgtatcaacaaaattatccatcctccacataaacattcactccctccttacccaacaactactaccattaaattcttccccccacaatagtaaccattccagtgctaacagaagtaccaggaacagtactcgaagcagtggtagtagacatagacgaaacccccacacaaatctccatatcaggaaccaacccctcaagacagtttctttttcccgagagggccggattccaggtatacagatctgccatagtgatgccgttgaagtggatgatgtcgtagcagtcgtcgtgactattatcattatattagtttcgtcatagcgtgatttgatattgaggataagagggtataggtagagggttactcacaccgacacaagccaccacttattacagtccttagtgacgcccggttggcgcggatgagcggtggggaaggtcacggtggtggatacgggtcttgtgcgggttttgggagtgctggggtcggcgatgcagtagtagtagccgttctatatcatatcgcgagttgagttagatcgtgaattaagtaaattaaaaaaaaaaaaaaaggatgatattggggaaagggaaaaatacgtacctccaaaccaatgcatttaacaccgacagcaggattccacgccacaaactgggccttatcgaacgtgccgaacatctccacgatcaaatcgcacgtgtcaccatcttccttcttgtaccaggctgtgcagttcttggctgtgcctgccttcattggatagggttggttagtgacggtgggtggggaggggaggttggtgctgttgtaggctgcgatgcagtagaagtagcctggtaggataccggaacagtctgcttttagggctgggttccattcaaacaggagggggaatttcagcatgggattgctggccaggatctgatcgcaggtgtcggactgggttcgtcagtaatgtaggtatgtatgtatgtgtgtggtaaataggacttacaggctgagcttcgtagtaggctgagcagcttggagcgagaccaggttgggttttggtgggtgggtaaacggctgtctccgttggaaggggacgcggcgtccagggagtgggatcgggggctgtgccattggtggtgggatagattatggtgagagcggggcgtttgatacccacgcacacccagtagccggcgatggggtagtcgcagtctgctttaaggtcggggttccattccagtctgggattttgcatgttagatagggctgactcgggtaggaaggatgggtactcacagctcgtccatggtaattctgttgccgtggcgctggtaaattgatctgcaggtgtctcctggcgcaactagatgccatttgtcgcaatttttgggctggccggggtgggttttggtcggaggccatgcggtgtcaatgggcgttatggtctggttgtatgaggtgatgggattacgggttgagtaattcgggttggtagtgaccattgtgctaggagtaggtgtgatagagggcgaacggggggttgttgaggttacagtcctgggagtggtgggagcgcttggactggtcaacgtagttgaagtgtcggaagtacttgaagtcacagtggtcgaagcactcgaagtcgaagtggtggaactagacgttgtcgatggaggcagggccgtcgtcgatgtagtgaaagtaccaatagttgtagacgggctaacggtcgtagtcacagtagtagtaactattacagtagtctgaccattcgaagtcaaggttgtggtcaaagtgagagtggtggtgaaagtagtgaaaactgtcgtaggtgccaaactagtcgaagtggtcgacgtgccagtagtccaagcagtagaggtggtagatgtgggaagggcagttgtcgaagtggtggacgtagttgaagtggttaaagttgttgaagtcgaagctgaagtcgctgtcgctgtcacagtcgatgtcaaagtcggagcaaccggtccaacgcccacacagtacgcataatctggccagaaattgaccaagcagtctagagagacagccggattccactgttgaaattgttgggggctgataccaaaagccttctcgaccgcatagcaagtatcaccctttttggcagtataaaactggatgcaatttggggcaatgcctggcatagtaggaccatgcggaccatttgcggccggcccaacacccacgcaataagcatatccggcccagaagttgaccagacagtccaaagaaacagcgggattccactgctgaaactgctgcggagtgagcccgaatgctttctctactgcataacaattatctcccttttgggcagtgtaccaccggttacagtttgctgcaatgccagtcatggttggggcatgaggagcagtgtctgcagatgttgggattgctactggaccaattcccacgcagtaggcgtagcccggccagaagttgaccagacaatcatgggagaccgcagggttccactgctggaattgctggggggtaagtccaaacgccttttccaactcatagcaggtatcgccctttttgatggtgaaccatcggttgcaatcggatggggttcctgacatggttgggccatggggattgggatccgctatagtgccagcgacatcgatagcaggggattgagcagctgcagtccatagcagtagcagcagggcagaaagccatgtaggaagagtacccattttggtggatagttcctggtcggtgttgtattgagagaatctgtagggactgtaggagaggaacaaggaaggtggtgaggaagaagaaaatgagagggagcggaaaatcaaagtagtggaatttatgggagctttgcagagaaaattgtaagcaggagtgaaatggttaaagtgaagtgggagggattgagcaagagtcactgggtggcaggtaatgattcaattaactacaactcggttttgtcatttcccacattcactcattctaactacgccatacaaatttgtccaaatgcctttcccccaacagtgaaagaacaagtaaagccacactctccctctctgaccctcactccatcagcaggcttaccaccctcttagcaaaagtggcttctaggtaaaacagccggcgtatgttctgaatgtcgaatagttagggcttctgggatcgttgaacaggatcctcactggtgtcccatacacagtgttatagagaagctttaagcccattacatcgtcaacactgggagtttctggctcatcaaagagtgtcccatccgccaaggaaagagtcacagaaaattcagtctccccaccattgtgagaaccgtaaagcatgatagagtcgaaatcaacgctggctttgttcgcccaagacccatggggagacatgatctcatcaaacggcacaggaagccaatcgatacttggaaacccgatgtttcgggcctgcgtaaagctcctgcagacgccatcagctccccagatccggtcctgtgacattccattggtcaattcttcaaaatccttcatttggttgcagtgaaaggtgaacacttggctcccatacaaccaataataagggttctggtgctcgtgatacatcccaaatgaatgtgcgagctcatgagcaaaagtagtgacccggaactcctctgtatccctgtgatacaagcatacatacattgcaggcttattaggactcggatgattggacgggtttagatagtcgttagaggggaagccaatgtccgtggcgaacagttcgggggtgtcgatgaccatcaactgttcatgtggcgtgttctggcatgcatctcggccaacctccctcactttgaactcttcaggcagcccagacgcataccataatctcatcgcactgcggtagtaattatgatatttcctccaggttgcctcgctttcgtagcacagcttgatggtcttgtcgggccagaggcgggaccagggctctactggcttgactgagacccaattggggagcataaatcgagcatgctcccactcaggatggccagcataaaccgtgggggtgttaagcagctggagaaggagaattggaaggagaatcgcccacatcttgaggagtatcatggcgttcaaatcgttctccaatgatggacttgagaggtaaatgtgcagaacaaggatcggaatggaggatggagatgatggggcgtaattgcaagatagaaggtacagaagaagatcattataatagagcataaatgcaaaagacttactcagaatttcgcctcctctctctttcactggaaagcaggccgttggttcactacagaaattcacgacacatgcacgtgcatggatatttgtaaacccctgatgtagcacatagttcgaatactatctagaagcgttaaataatttgagattttttgaacttgctagtagtacttgtaggctgagcagtgttaatcattcccagtatcctgaaaattcacgtctaacctgcaaattttcatattcttcccaccctcttattcacagttcattcctgtgtgctccttccactgcttctacaggctcataatattatttgagattatttttgtgatattaatttaattgaacttgtgcaagcttggtagtgacacatctaaactaaacagtcacaatcactccctagcattctggggatccatgccttacatgcacaatcccatcaaattctagccgtccttcggagttcgtccctatgctccttcctccacttcttccatcccagaatatcatcaacatcatcagtcccggattcaggaatagggttccgccgagcagggtagattcgtgatttgttctttcccatagccccccctagagcgtcaatcatggtaccatcatccagatctattgcccagaccatagttcccccaaggcaccgcttattggcatagtccatcttcatccgtagtgtctcttggttatcaatggaaacccattgatccttgtcccaggttacgatggtaactgctgcgtctttgtccagggtcatctcggtcccgcccttctgaatgatcttgttgacctcatacgtagccaacacgcccggtgtgccggtacattcacctgcccgtgcccctccagagaactcacagccaggcttcttgcacccgggattcttcattgtgaaactgcgaccgtagaaacctagtccaaggttaactctctctggattgatgttattgcgccagagaagttctagagcgctgttaatctccgttagattggtatgtgcgaaggcgtacggtccgagctgcttgttcgtagagtcccaagtgccgtctgcagatcagttagcgaggatgaagcaactccgaaaccgcagctcacttacgaatatcataagacatgacgttaaggaaatcgacatgcggctcgagattgacaatgtcgaatcctctcaggtaccagtatgatgtcggctgcagggatgttaacaacctcatgcatatcggcaggagagccaatcttaccaaagtgatggagatcccatactttctccccgtctgattcaactgttctctgagtcttttcaccaaagtcacaaaattgacataatcctcgggtctcccaccccgttcgtcggtcacagggtattcccagtcaatatctacaccatcaaaccgattcttctgcataaagctaatcaaggatccgaagaatgtatcctgagcagcctcggaagcggccaggtcagagaaagtggttcgggtcggacccgggtcattgaatgcccatcccccaatggcaatccacacctcgagatgactctgttggcgcttgagtgctgttacgccttggtacaatgacgctgtgagattgtccatgggagcgatgcggaatgtctgagggtcgatggaagcgaacgcgtagttgatgtgtgtatagtagccgagggggatatcaggtggacccatttctgtatgaagttgtgttagtctgatgactcgaaggagtggtatcaagcaactcacttccacatggacgttccaaattccacccttcgtagtatccgactgtccgccctttggcactggtgccgctgcattggggagacacgacggtggcatcgccacagaagtccttggtggttcctgtagcagagttgttagaggagattgggataggaattaaacgaaggtaagaacccaccgcagaagccgaacttgctacaacaaacatttagcggacaagtggatgcttgagaccattctttcccccagccagggtcacactcgctcttgcgatcgcagttcgaggtgcaatttttcccgcagaactcgggaccaaaaccacaataacccgagccagtggagtcactatttcagtggtcagttactcatatatcgaacacaaagtatacatgacaggtgtctcacatgggtccgcagcatcctatcttacatcccttatctttggcacaggtgtacccatcatcactagcaaaggaagtagaaagaaattggaaaggatagacagggtcgagattggacggaagagctccccaagcgagattgtgcgcgaagacagcgctggaagtcagttgccaaccgaacaggcagagcagaaatgccgaaatgactgacatgttgacaacggtagtttgacaatgttggtaaggagaatcttcgaagatgggatgttaaatcgatgactatctttttaagaaggaaaaggaacagtgattaacccgggttagggccatggtgcgttcacgtgtagttcatattttgcctggctttcacttgaaactgaacttcacgcgaacagagaagaatttttcatggatatttgtgatggaggatcgtgctcgtgaatccgtgaatacgcctggataatttgaggtgttagggctgcttaccgcctcatgctccctcgatataaactcggtattctcctcttctacagcttttttttttcccctatctccctggtctcttccatcccatacgccagctcatcttcaaagacatcccgtcctaggatgatttggttcatattcctgctggtgattcttgtcactggcactcccgacattgatgctcctcaagataatccccccgaaactcatctccccatcacagacctcaccttcatccgcacatgggccgccattggcgacagctacacagcaggtattggcgccggtgatctgtggtctgacagaaaagaggactacaaatgttcccgctatgacaagtcgtatgtagccctcctgaagcatttgttgggtccacaggtggaaaaattctcgtacaaagcatgcagtggcgctcgcactggcgacatctacaaccaggcccgggagcttgataaattccacgacctcatagtcatgactggtggaggaaacgacttgtgcttggtatgttagcctctccttcttcattcatctcactataatgaaccctagctgacagactgcacagtccgatattatcaccacctgcatctttctccctttcaacaacgaagaaaagtgccagaaggtcattgagttggctcaatataacatcaagcagatcctcaagtccaacgttcgcgaagtccttgaggtcgctgtgggcaaggtgaatcagtttggcatcattatctatgccctctacggccagttcttcaacacggagaccgatgactgcgagaagaaccaggactgggccttccctggtctggctccattcaatgcattacctttgacccgcgagcgtcgccagcaattcaatcaactggttgtcgacaccaacaaggtcataaagcaagccatcgatgatttcgtcttggaaaaaggaaagtacttcccaagagtgcatatccgtaccgccgattgggatgccttcatgaaagacggcctcaaaggacatttctgcgcccctgaatcaacaggaaaatatcccgatctcatgcagcccaacttgcacttcttcaagcccgacacctccattgaacgccacacggaactgaaagcgaagcgcgacaacatcaccgacacatccacctcctcctcctctaccgacgaccctctttcctcattctacaactccgtcctcttccgctcgcccaaccccccggcagctgccctccacaagctgaacccccgcgaccccaaacccccaggctgcccgggtgacgggggtgtaggattcgggctccccgaccgctggggcaagtacttccacccaaacgagctcggccacaagaccattgcctccttcgtgcttgacggcatatttgcctcacgggctgatttcctcggcaggaagaaccccatctgccagcacagtttcgacgaattccgatgctggcaacaagacggccggaaagactacgcaagcgcggacctcctaaacaaaaactacaagacctactgcaaggaagtaaagcctcccaagaaaacagcaaactggaaagacgagcgctggttcaaccaactcaccccagaaacgcactacttcagcatccaactcagcgatggtgccactcagttcgactacgaacactgcatcgagtccttcgaacgtatcatcaactcctgcgacggcaacgaaccggagaacccgctgaattggaaattcgggggtcgctggactcgcgggagctatacttacgaagttaacgttcagaactcgttcaagagaccttggccgccgacgaaggaagttggagggttttgcgatagtagttttaagaggtttttccaaaaatataatatgagagggaggggatgggcgacttgggatgcgggccaggatacgctcaagccggctattacaagctgcgtgggactgggacttacggggtgggactttaagtatttggatgagccggactctgatgggaatgagtgggtggctagttttaatacgcctatcttgacgggtcctcggtgctttgataataatcgggtgcagttcaacgcggggggtttcacgcggggttgtcatggggtgcagcgacatgatgcttgaggtggatgaagagatggttggattagggttacgggtgagatagtcgggaccgaagggggatgaacacgctcatgtgaccgcttgtgaagatgagaacatgtagtctaatagtagccagaggaatgagttgaatctatctacttacttgattattctttgggttctatcttctaaaaataatggcaaagattgctgtgttttaatctagtaatgagtgtggtgacaggaataactacagcatcatgatgtatccgcgcccgaccaaataaactgtcattgggttactgtttcccagccatacacaaatccatatgtgtgtttatgtatatcttttactcagaaaggagatatatggcatttagagctgcgaatcgttagcgtgagtaagttatgttctgaaggtggtagagtagtagggttgttttggctgcttggcgccttacacatccctttaacgcctgccaaggatcttcggtcttcgcgcccgacaccaggtataatatctacctaccccattgcatgattcatgctcgttggttctctatttccaataacccggctcatctcttctttgctgctgaatctgcacaaaatattggccataaggtgcttctgtttctatgagttgcagtccttaagtcgtgcaatgaagcgtatatcctttcttcgcgccaaacctctacagctctcgcgttcactatctactacaccatccattccccaacacgaacttgtgaacgaggagctcagtcctggctacagtcccaaacacttttaccctgcgaagcccggggaggttcttgctgatcattatcaattgctggttaagatcggatgggggggcggttcaactgtgtggcttgcccgagatgtcgcaaggcatgttttgactttcatatgtaactacggccacggttcgcacttctaacctctattcgaaccattcggttagatatcgatggcaggctgagcgcattgtagccctcaaaatcctcaacaacgacaatcccaggggcgcctaccatgagcgtcgtattgaagaacacatcgctcagcagactccctcacaccgcggtcgtccggttatccgcagttaccttgaaagctttgaattggcaggtcccatcggcaaacatctctgtctagcctacgagccagcacgggagcccctctggttataccaaagacggtttgaaggcgacaggttcaccctgccgatggttaaagcgtatattcttatcattttggctggtctcgactacttacattcagtgtgcagggttgtccatactggcaagtctgtccacctgatacccaaaagtcattaacctaatccattgttgtcagacctgaaactcgacaacatcctcatacccttcgaaaatgatgatatcctcccgagattcatcaaggaacaagaagaagctcagtcgatgcaatgcaagacagatccggaaaccggccgcgtcatctaccgctgtcacaacaacttcggacctcttgacccgagtggactaggcaacatataccctcaaataacggatttcagcgccgctgctctactcggcaacggtggagatgatggcgccgtcaaactaggtactcgtcctatacaacctgattattatcgcgcacctgaagtcgttctcggctgtggttggagctacagcgcagatatatggaatctgggagttatggtaagatatacctgcattcgaaacgtacgtgatagtcgaatagtactcacattctgcaacaacagatatgggatatacttgaaggcacagagttgtacacccaagtacaagatacggagggaaactaccttcccagatcacatctagcgcggatgatagccctgcttgggccctcgcctaagaaattgcttgtgatgtcagaatccatggcacaggttgagtggtctccagctatcacagatgaaaggggtaaagtctacaagaataatagggaatactttggtgggcctttctttgataaagatggtattgacacccattccccttttcccggcattatgcatgtatcctccgaccctaattcatattacggcaggcaacttcctctacaacgatttagtacccgcccggaaactggaagatgcagtcccatctccagaaacgagcgacagggaagctttcctatctttcatcaaacagatgctcacatggttgcctgaggaacgaaagacggctcgggagttgatggagcaccctttcctcaacgattgaggggctggtgagctgtgttagtattacagttcaaccaagatgcctaattgcgttctcactaggggtccatcctaccagtactacttcatatgctcgcctcgacttgttggctcttaagatgtgctcacggtaaggaaagcagcagcttagactgctcaatcatcaaacggtcagaataagatatccctgaagggtatatataacgatccactttataataccgtctcaatctggaggatcaaccgaatgcgatccagacgctcggcatccttattgcggcggaattggaaggttcgctaagcgttttatgcacgtcttggcaatacttttggccatttacagccggcatttccaagttcatgatccgattatcatcttctttctagaaaggcggatgcgcatggcctgcttgtgaactttgtctcgagacatatgatcatgctatctatttctgttcttgctggtaagccagatatttattattatgatgagaagaaatcaatgatatagagtgtagactgtagcgatgcggagtagtagcgatgtgctaaatatatgaaccaatcagatcaaccagtcacaaatttaaaggtccttctaaacagtcatctggtagttccccaagtattgtggagtatcactcggcctgaggagacgctaatattcagattgttgtactagtttacgcctgagttatataatactcagtttatatgatattatcatgtaaacaatcatcatgatggtgtcgtgagcggcaagtcttaagtttgtgaggctgaagtttatcccaacatttataggatcgcatataaccctatatcttaataaaaggattcctatcatctgtgaatgtctactactgttgctggtgctgctgctgaacgcaacgactttcagctaatcgttgatctttgaacgcttcataactcccaccatctacaactacatgcacagcaggcatagtaatccgtacacatatgtacctaacaagcaatataaactagtagcaaatcggaccctgaagcaaaagaaaaaggaaagtaaactacagtttcgtcatggctatcatcataatcataagaaaatagaaaattataccctcctcactgcccaaatccatccaacatatctacattcccagcaagtagataacctcatccacacctcacaaactccacctcagatctggtctacaaaacagtcagcaacccatcagcccccaaaagtgtagaagtggtgtatcagggaacatactcaacgtcatactcaaactaacatccgtgttctcgaccatatccgtaaactcctcgaagctaatcttgccatcaccatccttatcggcctccatgatcgtcttgtcgacaatctgctgcaactgcacatccttcaagttattgccgaccatcatcttcagcacgatgaacaattcgccattggagataaacccgtcgcgatcgatatcgtacactttgaatgcgaagcgcagcttctcttctttgttgcccttggaactgaaggctgataacccggagacgaattcttggaagtcgacatcgccgccgccgtcttcgtcgaaaatggcaatcattctgttcatttcattttatttggttattattccgtcctttgtatttgggtgtaattgttgttgggaggtagtatgggggaaagtacctcgtggcgagcgggttggaggagacttgaggaagggagaggaattcatcgcggtcgatggtgccggagctgtcctgtatgcattcacattatggttagctctagatatgggagggaggataacgtggagaatgggggagtaccttatcaagcttcataaagcgcttgcggagacggtccacttcatcgcgatcgactgccagattccgatgatgtagtcagcaagcccggacaccccgattgatattgttactaaacgcgaccgctacccacagttggaggcggacacaatgttgtcgaagagctgagaagttccgacggagcccctgcgtctccgcgcatcgtaaagggccgcgttgttgggttcgctggaatgatccatgatggggaccggaatgtggcgatcacagggaaggagagggagacggagaggaggatgccgttgggagaggcagaacggcaacggcaagaaccacagactaagtggagaagagaagggcttagaggagaggaagctcttccacactaattcacagtgaactctggggaataatcacgacggaacaatagattgatatcactgcaagcaacgaggttcccccagccggcaatttgatatcgggcagccccgcactaaccggaaacggacaggcaagcgaacccctgaggccgtgcgccgggccaaaacaggccaccgccgggtgacattgcaacgtcaactcatccgccagtgccaatactacgagatttccctcgtcgatatcatcccatcaccatcgacgttcatcacgaaactacatctacgcgctttcgcatgatcggccctatcgcctgataccaattttagcccccctcgcccatggtcgttgcccttttccgcgccccaaagttcgtatgactaggtacgggggaatggggaggacgcgcccgaaaaagctcacctccaaggcctccatccccatagttcgggagcacgacatagatcttatcgacgatgaaatccaaaatgccctacaacagatcgagaccggcgtggaaaaggctgaggaatcggtaagtgatgcctcatccccgaccgttgcgagcatccctttgcatatcacgtgacatcatcccgacctcaccccatcgtgaaaatttcgcaccccggcagaaacgccgcaacagcgcctgctaatgcctgttcttgtataggaattccatcttcaggtcgccataaatgcggctgcgcagggaaaagtaaaagatgcccatattccgacgccggaaacggtcctcagtaacctgcgctatgatgagctctacccgcctatcttttcgcaacctgcgacctacattcgcttctctgctacggtagaggactgttgcggagccccgtattgcatggatgaggaagacgatgtcttcctcaagatcttcaaccaaaaacgcgatgcgggtagtcggtgcaccgaggaccagttcgaagaagttatgagcttcttcgagctcacttcgcgaaaggagcagccatatgcttttgtagataattcgcccctcatgagcttcgaagaatttcaacaggcgatggatccagctgtagaggagagtgtaaagcggttcgccaaggacatctatgaatactggaagtccaggagaaccagcaacgggaacgaacccctacttcctacaccgaaggtgagtcccctcgctaactgcagtcatgaggtttggcaatgtcggagtgctaaccgattaccgcaggttgaggctggtcgagacaccgatgatacagacccgtatgtctgcttccgtaggcgtgaggtgcggcagacgcgcaagacccgtggcagggatgcgcagagtgccgataagctgaggagactcaggaaggagctggaagatgctcgacagatggtcgctttggtgcgccaacgcgagctagcgaggaaggagatgctggccatcgaacgccaagtgttcttgcagagatcggaggtcaaggaaatgaagaggaagctcaacatcaaggacgatgatgaggacctcatcaaccagaaggtgagccctatgcaatcccgcgaccgtttgcttcacatgctgatgactgcaacagccgaagaagaagccagtagaagcaccagctgtgcaacgcccggccgcgcctcaactgcgcatgccccccaaggctggtacacaagctgcagaagacttacagctgttggaggatgttcaggcagagaaggagaacgagattcagcgcgatatcaagcagaatatcgccaagcacatcaagtggaacgagggctatgtggatttcacaagagcacctctctccccgtcgccagagcgaacattcgatgctgcttctttccgccctgcaatcaccactcaactgcccacgccaccatcatcggaatcgtccgataatatgctggattcgcccttagataccacgagtgccattgctctccgagataaattagctccacatgccatggaattgagtgtggacaccagcaagatgccctcattcagacgacgtatcgggcgtggcggtcgtctgtggatcgatcgtcgaaatctggtgtcccgttgtagagtcgaaatggatccgtggaaggccgatcggttcaagtatgatcaggaggactcggacgaggatctcgaatttgaaggagatcagtacgatatccagatcatgcagcatcgggcgatcatggcagccaaagcccgagaccaagcagcggcggcagctcaagcccatgcgcaggcgcaggctcaacaagctcaggctcaggctcaggctcaacggcgattgcaggccgagcagacgtcggcgaccaatccaacaagtggagggcaaaccatgggatccaatcccgggcctggcgccattgcctccacttcagagacctaagctgggctttgttcttctcccctctctcttcccttccgcttatgtttttaatctttcaccccatgtttcgcatctggccggcgttgttctttcgacatattctcttaccctcacctgtacttttaccccctggacgtcctgattttttaccccataccccgaatattcttttttttctttcccggagcgctggaaagcgttcgaacctcaggatgatgttgccggatgatgctttgttttatgacatgaccctggtattatgcgaaagttagtgtacatagccagttttgtcctcttttttcttttctttcagccgagcagtcgatagactcgtgtacggatagtgaggctatgaggtcagcgacgaagaagataacaaaaaacaatattaattagatgaaaaaggaaaaatcaaactttttggtcttatccatcataataaaacattttttcggtttcgagaataagcgtcacgtcctcagagctttattcctctgcggttcgtcgctgtcgccattcgctgcccgcttgagagggttgctctggagtgcggccccgaactggttgttgagcatgaaggacagattgtacaaaacctccttttcgccgaggcggacctgaatcgccatctttttgcgacgaacagatccttccaccggacccgaggcctcaagctgcgacaactgggcgaggagctcctggtcctgggcgatggtcgtcgcatactgggcctggttcaactgcagagccttggccaagatagcggcttctgaatcaccaaaggacggcttgggaggcttgttctttgagcgctgcttctccaactggtcagacgggagcgatagggtcttcaacaatagcaagagctcatccggaagaatatcagtcaacggttcctcaggcgaagaaggccttggaatggtatagccatcgtcaagaagttccaagtcttcgaggaattgaagctaacgtaagcgtcagcaagcggtttgtatcagagggtgttttattgtcagcgatttaccggaggttgggtctcaatatcagcacatccaaggccagcagcctggcatatttggtccaatgacagttcgacaacgtcgtattgggcatagttgtcagtcacgtaaccgtaccgtctcaggaggtcagaacgtgggatctccccgtagtcgttgaagatctcctcgcccgcttttataggcttgatagccttcatgaccaaaacttcttcttcttggaaaagacgagcctaagtagacaataattgtcagcgatcatgtagcgagaatcacagatcaaatagaacccacattgttgcgatcggcatccgcattgagcagatcggccagagggaccatgcccttggacgactgctcttcttcttcgtcggtcaaatagccgtcttcgccatcacgctcaccctcttcatcttccggtttctcgatgtcaaaagcgtaggccatgataagcgatcccatagtgtgagcgaggtgaaggagggcctgggttccagcgtctccatcgtacgaggcgactccgtcgatgggaggaaatagggcaggattcgctcgcacgataggagcaattgtctcgagaatggattcctcagctccctgctttccgatcttctcgacaatagcgctgccctgaagctcctcaagctcggaggcggaccagaacatgagggtgtcaaaattccgaggaaggacccggaagtatgaagcccaagcagactgatcgccttgaagatactcgtagatcatgacaaccatgagagataaccaaggaccaaggtcgtcgagattctgagagagcaggttcttcaagttggaattctgaaccgagagaacgtgtgcgcgggggatggtaaaaagctcttcaccttcgtcgagatcggactgagccactggtagagtgacacgaggacatcagagagggggccacttccaagaaaaaaagggtttcatgagacaggcacgagcgggataaaacctcgtctgggatgggaacctaccgacacctctgccagcagcgtgggagcgcagatctgcaatttggatcttggggttgattttgacgccgggcttgccagccagccaagtgaggaactcatttgactggtgctggaagttccccgggtcgggaaaatgggtggtggaggacatttgggaggttgatggaggagagattgtgtgaatagtctcgacctaagaaaaaggaaattcggcaccccacaccaccgttgtgttaaggacggctcaggagtgaaaagagcgggaagaggagcaatttcacagcagaacaaagagaagacgatgcagctgctgggatagccagccaggtggtagaaggaaaggggagagtgtgggagggtgagagagtaagagagattgacggggggtgaagttgaggggatcaggcggtgctcctccgtagtaagtaaagtaactaattagtagtaattagttggcaggcaaacgggcgtatggaaagtatggtacagtaactggtgttccagcaaaatgacagtcggataaacgctgcggcggtccaaaacgggccaatcgataacacgcctgataaccttccgaaccagcaccgaatttgcccctccgcgactggctcatgtccgcggcctcgaaattttgaccagcctgtaaccacaccttctcaagtagtggtcccttattcttttttccgtcattgagccagatacccccagatacccccccccctctgcacatcatgatttccatcggtctggagagctccgccaacaaactgggcgtgggcatcatggtgcatcccgacgatggcaagcccccgcaggtgctggccaatgttcggcacacctatgtcacccctccgggtgaaggattccttcccaaggacaccgcccgtcaccaccgcgcctgggtcgtgaagctggtcaagaaggctcttcgtgaagctcggatctcccccaaggatgtggattgcatctgcttcaccaagggccccggcatgggagcccctcttcagagcgccgccattgcggcccgcatgttgagtctactatggggcaaggaattggttggcgtgaatcactgtgttggacgtatgtgttatgcctagtacttgatcggtttatttatctatcagtcccctatcctatctgcaccgtgcggggaacccttttgccccttctcatcccttgcatagcttggccctcctattgcaaccatcgctgacaatgtcccggttgtatatatagatatcgaaatgggtcgattgattaccggtgctacaaatcccgtcgtcctctacgtctccggaggaaatacccaagtcatcgcatacagctctcaacggtaccgcatcttcggcgagaccttggatatcgcagtaggaaactgcttagaccgctttgcgcgcacgctgcgcatttccaacgatcccgccccaggatataacatcgaacaattagccaagaagggtaggaaactggtcgatctaccgtacacggtcaagggaatggacatttccatgtccggtatcttggcggccattgatggactagcagtgcagtatggcttggacggagactggaatgacgacgaggatgttgctaacaatgcatctacatcggacgatctggagaacgcgaaaccgacgcgtgcagatctatgcttctcgctccaggaaacggtttactccatgctggtcgagatcacagagcgcgccatggcacatgtcggctccaaggatgttctgatcgtcggtggagtgggctgtaatgagcgcctgcaggaaatgatgggcatcatggctcgcgaccgcggcggtaccattcatgcgaccgacgagaggttctgtattgataacggcatcatgatcgcgcaggctggattactggcatataagtccggtagcacaacgcccttgaaggattccacttgtactcagcgcttccggacggacgatgtctttgtcaaatggagggattgattttctatttcttgttccattggatgatgatgatttagatgaatgagatgaatataatctatagagtcatgagcaaaggtctccgattatacgggattcggcacccggagtgcatccgtacttccaggcaaactgaggcataggctagtattgatggaagcccgcttgaccgcattcttgttaccgagtaacgattggcgggatttgactcaatgttgccacggattcagatgacaggttggggtcaagaatatcaagtcgatcatgactagctgtcccttcgacgggtggaaacaagcgtttaaaggcgtacatcatacactcctggttgaccgaaagcagcaacgcctatgtaaaacagccgcgcatttcagctgcaagcaaggttaacaacaggggcttagctaacaaatatttgtcgctagccatgcatcgttccgaacaccaacaacaacaatggtctaataatggcgcttttctgcaccgcaaatagtcggacatcgagcaaccatagggacgtaaatcatgcaaagtggcttggtcctgggttccggctatgtgcatctctgcatgtcgaaatatatatacccaaaggagatatctgttgtttaacccccccttggttctgcgagggcctcggtctcttatcctccagctcgatgcgcagttatagcatacagtcgacatgcgggatgctcggccccgctccggcagccagagtaatacagtccccttctggctgaatagaaggcatgagggacgtgcagggcatcttatttcgttgacaggctaatccgtaatatcacctgtcggtttgtacaatatcgttgtgacgtactacataccattagttctgtgagtccgtgacaaagaggtgccaacttaccttccgtttgtagcgagtcgttacgctggtggcaagcacaccattcttgatactgctagtagcaagatgatttaggacggtgtggttagggtagttaagaacgctgctatcgtccttcatgggtgtggtgccgttcaagattgatttgccgaggaacagcggaagactcggcggtgtaggcgcatccccaacgatattcacagcttgctggtactctggtgtttcttcctcgcggtctagatcaagcagaaattggggaataacaccacggaagtcaccaagcgggatctcctctggctcctctctgtctgactgttcctccacggtggaccccacttgatcgttcccgaccggcccaggaatgacctgcgggggtcgaacgccatcagggaccttatcgctttccctccgtgaccggttgacatcatcagcactgatttcaatatagttgacaaggtggttcgtgaaatcgactgccgtggggaggttatctgaagcgcgcatttcaccatcgacaatgaatttcaaatgatgcgtgcccgggcggaggttcaatctcgtagacaagacaccggggttgttctcactgtttatgcaaggttccagttagttctagtaacgtacaacagcccagataacaagtaatgcgcctggacatatgagacagtggatgaggcagcatggcatacctccgatgtagacggaatttcttttcccagttcacaaacgttcccgtaacgtagaccttatcaccaggggcagtccactctatcaaggttggcacagctcttcccacgccgctcggagtataaggttgaagttcatccaatgcttcatcgtcatcgaccgtggcgccactaacggcagattgtctcgactggtggtgttcatccaacaaatggtcgggtgcaaccgatcccatatacgaatcctccggaccaataataggcgaaccaggggtggctgtggcatctccaatgggcagaggcatgcgcggtgggcgttgaagatgaacagaagcactgtaataggcatggggaggagggcccgagggtgctacagggtcacgttttgcggccgcccgagaacccggaacttgaacggggttggacggatcaggggcaggaatgtctttggagcgagtatctggtttcttcgggacctgacggtctggccgatctagattccgcgtcggtagatccgtgacattgcgggattgtagacgctgctgaacggatggttgagcttgggaggtcgggtggcccgttgcggtttctctagtggcggaggggtcggctgcggaagccttggtggtgcccgatggtgtatgaatcgatgaccggcgagctactttcttgtcccccgccgcggccgagggagccgacggcgattgggcatctccggcagggggtttggaaggattgttgcccatttggaacagggagccggtggaaggcgcttgtaggatggaaagggaactgagtcaggcgggtccaatgccgtattaaagacaagagacgagtggtgggtgggttctgtggtcaaggttgagatgccagcatcagatggtgtcggggtttggaaggcggaggggtaacggaaaataaagagggagtcggggcgaagggaaaatatcgggaagacagaggccttcggatgcagatgagctctagaatatatgctgaccgggataggaaaagcgccggctcatggatggggtggaaagaggtatataaacagagcagcgggcgaggatcgaagagaaagaatgcgatgggcagcaagtaagagttgatgatgtcgatgtcgtcgaccccggacgggctagtcccatggagaagttccccttagggtttagggctccctcctggtttcctccgacggtcggctgtcatctccgatggtgacttggtatatttagttggctagtttatagtagcacattctgtcatctcaaagaagatataccaatcatgctcatggcatccttccataaaggagtatgaagtcccatgtgatgaaagaggattggtttcactcatacaatactaagagtagtcactcataacgataacaatcgatgaagcaaaccagccagccaaccaacacatttctgccacagcagaccgcttaccatacaaacagcgccatcatccaaccccagcattattcactctatatttactttactgccgtatcccttcccattgcacagcaaagtcatgccataggttccctcggttgacgcacggggaatgctccatgtaaccaaccagccgctttctgaaacactctagccacgcaaatgacttgggtcaccgtcttgacagcgaccttcggtgccgtgctctatgctctggcttacctggcttcctggatctatgggctattcagtgtactagcctcgcccctgtggatcctaggccatgccctcctttatgtgctcctttctccgctaaggcttttactcaaattcgaggtatgagtggctcgatttttcatcttgttaagcaagtactggtcttaacccgaggaatgaacacttatggttcacctaggccattcttagctacctcacagtagccgcaataatgggggtggttctgggaatatcaatacactatgggtcgtcggttactgtggaggcgattcatcgatggtttagttcccggaagattaacacagctccccgtagacgggatagttttcatggacgtctacttgacaaagtcaaaagagcttcttctccgagcgattccaacgcatccgacgaggatacttcggagtgatagaccgaatggggggagcatggcatcgtctgggattctcgaagaggaagaaggagccgggccgaggattcaacgggcgcttttaatcctgagcctagtctagggcatgtgggcggaaactgtagtgattacgtctgtactatatattttagcattagcatctgttagtttatttcgcagtagaccataacttctacaagatatgagcggttcgaccgaatgcatgacagatactagcggaggcagacgggatcctccctggcggatggggctggtaatctccggattaattgacgcaatcaatccgcgacagcctggatggaccctgccgcttatccaaattccccactgcaattatacttcaatgagacaggcagagagtcaccctcatgtttatcttattaacaattggcatggtcttcaatttctactaatttggcaccttacttatagacagattcttgttcatatttaccctaagcatcgattcatttgctcttcttttcccgccccttctcaccgcaatacgaactactgggggaagcacgaaaaaaaaaaaaaagtataaatattaacttaagcattacactgcagcccattttattctaccatggtccaccaaaaaacaccgatgtcatcactcctgattgtttatttccacttgacatgaatcatacccctaccactacactattactctccctattcaggacaaactacttctgaagtggactgcttatcaccgagcatcgtccggtgggtctctcgaaccatcaacaagaacaacccctcggtctcgaacggaccatcctgcaatctgtccagggttcgcttcgcttgttcatctccctccgtctctcaatcttcccttgcaaaaacacccccccaaacactcatttccttcctttgtttctaatctcaagggtgccctgcagttcctatcttcgttgacacgcatgtcttctccattcatcagcctcgttacaattcctgtcgaaccttgctgacgccttcccgaacgcctccaatgcctcttcccctgcgctagcggtgtcttttccgatataacgactacgtcagaccctccgtgttatactttgcgatcttgacgagaccacgaactcgttgacagccgttgacattcctgtcgcagcataccagacacaatgttcccctctcgagcgtttctacgagtgcgctccctactacttgcgatatttatcttattaacattcgcttggtcctattcacgatggcgcagctatcctctccctgagcaagtgcgatccatacaaacacaccaacagcctctctcgagcaacagacataccgaaggtcacattcaattctggcgccaatttcagccacttctgaccgctcatgagccaaaatgcgagccacctctgagattaggatcggcgccttcaatcagattcgaacagtcgaaccctgaagaccgcccggagctgctggacatgctcccatttgacgtggatatgatgaaaaatgcacacagcggatttgtcgatgcaatcaataccaacccgccccaactaaactataccaagaatacccgaggcttggtttccaccgcggggggctcttacctacccgtgctggtgatctcgctgcgaatgcttcgcagaacgggctcaaagctaccggtcgaagtcttcctcgcaaacaaggaagaatatgaagatcacatctgcgaagtcgtcctgccatcgctgaacgcgcgatgcgtgctcctgtcggaaattctcgacgccgtccctggtgatatgagagtcgagaaataccaattcaagcttctcgcaatgctgttctcgtcttttgaagaaattctcttcttagacgccgatgcgttcccgcttcacccaccggaaatgctattcgtcaatgggccctttccctcgacgaacatggtcacttggcctgacttctgggcatccaccgtttcctcctactactatgaaatcgcctctcagccatatcctgagaactcagtccgacagtccagcgaatccggggaggttttgatatccaagaagacgcacatgaaaacccttctcctaagcacctactataacatgtggggtcccgatttctactacccattgctttcgcaaggcgcagctggggaaggcgataaagaaaccttcgtcgcagccgccatgaccctgcaagagccatactaccaggtctcggagccaatttgcgccatcggccacggcacacagggcggtctggccggctctgcgatggtgcagttcgatccaatcgaggactatgccttgacgcagaagggtgagtggcgggttcatggatcgaaggcgcccgccccccgagcattcttcattcacgccaacttccccaagttcaacccggccactgtgtttgacaaacaggccgtgaacccagcttttgcagatgacgggagctatacccgcgcatggacgattcccaacgaagtaattaaggcctttggcaccgatgtcgaaaagcgcttctgggacgagattctttggacggcgtgcgaactcgaggataaattcagtacttggaaggacaagaagggcatctgcaagggggtgaagaactattggaacgccatgttcggtatcgggcattctcgttgagttagggtggggtcccgagtttcagccttagcgctggtcgcttatgaacgatcttcaacgagacacgaagtgacgaagacgattggcttatattaagcaatcagagcgacatacctacgcccacgttccatcaaagaaacacgaaccaagataccttggaccaccagccttggatacattctttactacatataccacagacaatttcagaaattaggaccctaaccttttcatcctcgacaacatacagatactcaccacgccatgtcatgccatgccaccagccttgcttcttttcatgtatcatataccaatacccatgcagagctacaccacaccacactactataaatacaaacccgttgatgtaaatctctatacatacaatctaagctaatgatacaatccaaagaagagaatcatatacctcctccacaaccccctgaaaatacacactccccctaatagataatcacaccttctcaatagttcccgcaacctgcgccttcctaaccgcctccctaaacaactccttacatggcactcgactgcccaacctcgcgcacaacaaaaacgccccactcaacttccgatgcaaactatacgtctcctccggcggaggcgtcaacctctcccgaatcataaggggaatcaaccccctcacgcgatccgtaatagtttgatttctgaagtcatacacatccggcgacgactccatgaacggctctgcaatagtaataacggaagtaacgtgcgcatcgaccatctcctgactctcatggccagtaagatatcccagttcgcgggacagctccgcacagcgtagacgatcgttcctcgctgccgcgatcagcgtgttcacatacttagtgatgaactcatcggggtattcgcgcgaagcgccgaaatcaagcagttcgagccggttcgtctcggcgttgtagaggaagttagtccagttggggtccgtctgcatgtatttgaattcggtgatttcgcgaagacacaggcggaggatttgggtgccgatccagtcgcgttgggattgggtgaaggtttggattttggtgacggcgatgccgttgagacgttccattgtgaggacttgtttgcccgaggcttcggggatgatggcggggatgtggaagacggggtcgtcggcgaggagcgagcggaagtgctcgccgcaggtggcttcgcggtggtagtcgcattcccaggcgagttcggtgcgggcgttggcgatggttttgtcgaggtagaggccgcgtgggaggaggcgggaggcggttaggaggatggagaggttgttgaggtcggagtcaatggagtcggctacgcctgggtattggattttgacggcgacgggttgtcccgtggaggcgaggacagcgccgtggacctggccgatggaggcggctgccatggggatttcgtcgaaggaggagaagaggtcgcgccagttgggaccgagattgtcggtcaggactttatcgcgttgcgaggcgggcatgtagtctgcgcgatcttggactcgttggaggacctcgtgaatggagtcggggagcattttgctgtctggggggtgttagagggaggttggtttaggggttagatggtgtgtaccttggatgctcagcatctgccccagcttgagggccgccccacgcatcttggagagtttggctacgagacgttccatgttccctgcgctgaacatgagggacccggtgctttcggattggctccctgtggctcgtcggaggctttcgctgacggcgccaaaggccatggatgtggctaggccaccgtattgccatagcctgcctagtcgggaagctggaacgcgagactcaatcatctggtacgttgcctgctgcttcatggctgcggcagtctcaggttccacctgcgggcacttttttagatatagacttccggttgcttgcggctgcttgcacttactgctgttgttgacacaatttcatccaccacctcggcctcttctttcgacagtccctccttcccgatgggtttgacgtcaggtggaggcgtcggggaccttcctttgtatctgagatctgcagcagcttgccgagatagcatcctagcaaccttggggctgtggaatatctccttcatcatatcctccgaaatctcctcctgttgttccgtaggctgggttgtggacgcggctttctcggcaccgacgggggagtggaatacgtccgcattgatttcagtattgatgcctgtttgcgtgtcgctggatgtcttaggtagcttaaccctaggaagaccagacgagccgggggttgtgtgtgtggagggttcatagaacacatcttgctgctggctaacatccaattgactagctccgtaaccggtggtctctgctgtagacgacgggatctgtgactctgcctgtcgttgcgctttcctgccctcatccggggagagattcgtgtgcgtgggggatgagctcggggaccggggtggcggtgcggatgccgattgggggggagaaggatcatcattgaaccgctttgctagggctgccgcagcttgtgcggtcatacaaaggccatccgcttggcttttgatgcctttggtgagggacgaagtcctggtaaataagtctagctggcgctgccgcacctcgaggtgcttcacggccacggacttggcgacattgaagagttggatcgcgtccaacagacgcttgcccgacatgattggtaaattagcagagaaacccgggctggtctccgaactaccgtcttcgcatgatggaaaatgaagcaattggaggagcgcgagagcaagccggatagcatctcgtgcctcgaaaagccgcggtggttttctgccgggcggcaccgcccccggggaggtccggaggtgactgataaggaagacagccgaccggataaaactaagaatagtatttaaaggcgaatgttcctcccgcgggtctccctttcttcatcaccgccatgtaccggccgccttaacttgtttggtgagggcaaatgacagtgaagaccaacgtgcaggatatcgagcaagagatcgtggatctcgaggaccgtctgcgcaatgcacgtgctcgtctagcgtcggcctctgcgtcgcacaagggcgggggttcatatctaccggtaccggagggtgtgtttgccccccggacgtcttccccgtacacctccttcttccgccccctatctacaagatactaaccgtcaattcctacgctccagatgctacaggaatagtgcctagccatgcgctgctcctcctgtcggattcagcccttcccttgggctcgttcgcctactccagcggtctcgagtcgtatttggcgcacaacaaaccccttcctcgctcggtgacgccgattgcatccttccagcgcttcctgaagctctcgatcgcttcaatggcaagtacctcacttccatacgttctggcaggatacagacgcccagaagacttggagaccctggacaatgacctcgatgcgtccaccccctgcatagttgcccagcgggcgagtctcgcccaagggcgggcattgctcggggtctgggagcgcgctttccggaaaacgtatgcgttcaacccattccacgctaaccccaacactgccgaggctgtgaaggtggttgaggaattctccgagatattgaagtcctcgttgggtactgatgaactagggcccaaaggtcactttgcgccattatggggggtggtgtgtctggccatgggcatggacgcccaccagactgcctatgtctttatgttgaaccatgcaaaggcagtccttagcgctgctgtccgtgcgtccgtcatgggcccgtatcaggcccagaacattctggccagcaagggcctacaaaacatgatcactcaacgcatagaacgggagtgggatactcccgtcgaagatgcaggacaaatcgtcccacccctcgatctttgggtgggacgacatgaacttctatatagtagaatctttaactcataatgcatagatcaccacgatagctgtctcgcgtctcttctcgtcaaaggtgacattcttgtatgaatatagttgcattcgtcatctttctctccgccgtgacttcctatttaatcctacaacatgcaccgtattgtcccacccaggtgccgctcgaacactgacgtgggtatccaaaaacaactcctctggaccggagggtaatgagaagaaaagggaaaagaaaaagaaaagaaaagaaataagaggcagaaaagagaaacgaagagagaaagaagaattaaaaagaaacaaataaaaaaaccggtaacccgaagaccaaacaacccggccactatgcaaagaaaatatccgatcaataggaacagatttagatcgaacgccggccctctgatatcctgtcctgctaaaccacagtaaaacaccgcaccatgagcctttttccatgattatggagcgcaatgggtaaacgaaaaatcaagccgtaataaagtgacgtaggtgagtgaaaaggggaaggcgagaaaggcaagaagggaagaaagaggagactatgatacacgaagttgagggtatggacccaggagggtgggttctgaacgaatcacagtgtgatatgcatgtaatcgttgttgccgaaggacttgttgcagttgggacactttcgggaccgagatgtgaggcgctcctccacgcattctttgcagaacacgtgaccacaggtcttgatggccgtgttcttgaagttgcggcgacacacagtgcagagtgccagagtctatagggtacgttagcgagaatgatccgatatggcaaaaccacggtaatggggagagaatataaacataccctcagcatttcatattcagacgaggagttcccgaggctcttattcttccagttctccaggctcttcttggtatccgccagggtcaccttcaggccctctacctctgtttccgcttggcgacaagcactcgaggcgctagccaatgtcgaatccttggaagctgacaacgccttgagttcggccacctgccggttcaagccctcgattgtgatgttcttctccgtgacctgttgctgggcggcgtaattcttgttcatcatcagattcaacgcttccttggtctcgctgacctgcttttccatgttggcaagcaaagaacgggtagctgcctcggattccttcagctgcgacacgatgtccgaagtcttcgaattttgcatgcgtaatgtgcgaacctccagttccctggcctccttgctcttcattgcagcaaaatatttctgatcggccttggatttctccgcgataagtcgggcgaccttctcctccaaggcgctgaaatcggtaactttctgtgacgccaaggacgagtacttcttgcaggcgacctgcatcgaggataattcggtattaagcatcgaaaactgacgttccaggttgctgaacttagtacgcaattcttcgatcgggatctcatcgacgctctttgacgtgctcctctccttatctaattccatacgcaacctctgaacctcggactctagcgccgtaatccgagcctgtccagcatctgcaagttcttgcacctttgtagccgcggttttctcctgctcttgcgcagccttgcgcatttgctggtccgccaaaagttcgtcgcgcgcgttgcgtatccgtgccaaatctgtttctgcccgcattaattgcgcctccttctcagcgatcgcattttgtgcctcttcatcaacctggttgcgataggcggttcgctccgatcgatattttgccgcttcttctcgtagttgcgcattggtcgcttctaaatggttgattcgagtaacaacatcatcgtactgggatttcaattgcttgaacaagtccgtgtgcgcgtagtcatcgtccgtaagtcgtgaatgctgcccatctcacattagcactatgcgagtctagctggcccaaccgggtaggcgtaccttgatatttagatccgttatttgagtcagcaattttgcattctcactctccaatttctgaagctgctccttctgcttttcagacacggccacgagtttgctgtgggcttcttccaaagcgggactccgctcgccgctaggggtcgcgccgttggacgcggaaggctcttccttgggtgcagacgcactatcgccgccggggcgttgggctcctaaaatgtactgcttctctaatttggcaaccgtcaagcttcgtgcacgatcgagctttttctcggctaccatgtaccgcagagaggcttcttctaaactttcttcgagttgctgtttttcagaaagagctttctctaattccgcgatggtggctttctcctcagccagctttttggcgagctgagtctgtaactctgaagcttcgggcgtggtcctgggggatttggacagtaagctagagatgacctggcggatatcctccgaacgggactttaagtgcttctcgaatttatcgacatcatcgaacagcaggctgctttggaaagccgggtgttctgggaatttgtttagcgtttccatgtaaaccgtcggccggcatgagtgggacccacccttggcatcctcttcggcagcgcccatgagcaatttgacctcgtcgaccaactgtcggttgtcagataatctgcacgggatgagcaaaatacaatgatctactcacttgcttgtaccaggtgtctatgatacggagatggtcattgtggtaggcggtggctttggacatctccttcagcttggcctcgagcgacaccttctcacgtttgtactcctgcatctggcgccatattgcgtctttttggaaacgctgcgacgaagagacgtcagtatgtcacctggagggcagcgatagagtcgactttgggcgttccaatcctgtctaggggaacccttgggataagttggcacccacgtgggcagatcggggacttacctccaggtcatctttccagggcatatcagcatcgggatggggtttgctaccaccattgaccgaagtcgcctgcttcttcaacggtggagcagaatcattatggtcgtaggcagcggctctcttccggtcttccatcatgacaaaaccggaatcggaagatgcgacgggggatgcttcggcggccggcatcagtggctaaagaggcatacgtcagaagaggccgtcaccactgagcagcaacgggccgaaagcagggaccgtaacaatctccgaccgtgaaagaggtgacggggggtggttgtggtggaagaaatggtgggtggaaggggggaagcgaggacgaggtggaagagggggatggagagggaatgagttgagataagcaaagactcccaggcaggaagaagccaggaggattttcggcctgccagtttagcgtcccttcgcgcctcccacgtgaccgcgcccactttccccaggagttcaggttcaggttcagctctttccgcccgccaatctagactttttgctggtttattactcccggtcccttcttctaccaccaccaactaaatcaccatctctccttcatcatcatcatttccccctatactccccccttcctcatttcatccctcccttacctttcgcttcagcgatgaccggcatgcagaatgaagtccttttccagttcggccattagtacgttctttgtctcccctcttcccgtgtcccgtcccgccttatataccttcaactgctaaccatgcctcctctgcagataagtcgggcaagaaatttgcccccaaggcgcccgctcgccgtcctccagctcccgctcccccgagaagacccagtgtagcttcccagccatctgcttctcagactccccaacctccgacagagacagcaactcccgaaccaggtccaccagcccccgctgttcaaccctccgttcccactcagccttcagttccggacgagccaacagtttctcccaaggaaaatgtcattgtacctcagactgcgacagccattccaatccctcgccctaagcgcaaggcttcggtgtctgcagtctccccaggaaccatagaacatgaacctaccccgcctacacctaccgcaccggaaccccaagtcgagcagatacaggctcctgcgagtgatactccgactgctgcgcccgagacacagatatcccgccccgataatgacgcgacagtgattcgtccatccaaacgtcccaagaccactggagaatccaccgccatcaccaccgatgccgtcaccaccgtttccgctccttctgctgctgctgctcctcctcctcttcctgctacaatcacgcgcacaaccgaatccattgcgatagacgccaacccccaactcgttactcctccagcaacgcaggcggcacttactgatagcgagggaactgcagatgcgcgccctagagccgactcgcaggttactactgccgaacaaggtcgaaagacaacgagggctagacgaagatcagtgaaggatgtcaatggggaaaatgcgacaaagaagaaggaaagaaagcctcggacacgcaagaagcgcgagccgacccccgaaggcgccgaatccgtcgagatcgcccccgcaatggtcaagatgtcggagctgtgcaaggatttgcgcacgggtaaaatgtccaagcgagagactgagctgcgcaacatggaacaggctgagcaggagcgtaagcaaaaagcgcagcaggaaggtgataccgaggcaccggtgaaagagaacgggaacgacgcgtctcccgcggaagaccgggatgagaacccagacaacaagggacaggctggaccagtgatgaggattgttaacggagagattgtgctcgatactgcttcattgcaggtggatcgccatgccgatgccgcaaggaatgctggggaacttgaagatgtaattgaaaactcgtttactcggaagatcaatcaggcgacatatggaaaacgctccaagactgagtcctgggacgaggaaatgaccgaccttttctaccggggcttgcgcatgtttggtacagacttcatgatgatcagcaagttgttcccgggccgttcccggcgccagatcaagctcaagttcaacaacgaagaacgtcgtgacccccagcgtatcaaagaaacactgctgggcccacgcgagaccatcgacatcagtacctactcggagatgaccaacactgtctacgacgaccccaggttaatccaacaggagttagacgaggagcggaagcgaattgaggctcagcacgccaaagagaaggaagcgcaggaagagatgcttcgtaatcctgacggtgcggccggtggtgccgacggcactcagggcaacgacgtgcctgtcaaagcgaagcggaacaacagaaaacaagccatgaaagccatggccggtggcactgaagaagttttgggcaccattgatgatataccttgagtacacaggatcgataaattcagttttacggccgatttcaataccatgcggggatacaggtgtttttggcgttgcagtccagaccagttgtactgcctggcgcaggagtttacttgggttcctgttcgtctttcttttgtcccccggtgatgatgaatgtctgtttgtttactctatttgcttgctgcaccgtggcggctggcataatgagaatttcccgacgatttggtcttacatgtattttagtgctcggtcattacaacgagagtatcgaaagaatcaaaggcttatagctaccgcatactccccaaggcatcgactgccgtttcgcgtctctgctcctttatagctattacctgcggcgtgttgagccaaacccggtacttgttccggtgctggagaagcgcggagtgcgcgatcctgagctaccctccccagggtcatcatatcttctggacgaggaggaccggctccatgtagatgacgaactagaccgattcccagcgcttcttcttcccagcgcataaccagccgccccaccacccaacgcacccgtccaaaacccgggtctccagcgctcattagggtccgaagaaggagtataaggaggcggcgaggctgagtacggaggcggagggccatcatccccgtaaccaccaccaccaccaccaccaccaccaccacgtcgtcgtcgctgtggccgattcgcccccgacccacaacactcattgaaaaacgctgccaaaatgaacgcaaaaactgcgatcataaacccaaagaagatcactttgcctccggggccaagctcatcatttgaagagcttgatctctcattgcgcaagtgtccaaatttctcctccccggcttccgtcagcagtaggcgatactcgactccacaactccctttcaatatccacttatcgtcggcattccggtatccctcacaaatcacgtccgtagccccgagcttgaattctcgtgggagtgatgcagtgcaggtccactggacgtcttcttcatcgtagtcgtagccttcgtttgtgcatcgcattgtgtcgatctcgtacatattgcagatgcgcttggacgggccggtgcattttagctgcgggattggagatactcgtcttgaagtggtgagacgatttccgcggagggtgagtgaacggacgcgcgagaggaggatggcgtctttgcctggggggcggtcggagagagcagcgtttgggaagacgaggagggaaatcaggagctgtataatgagtagagtatacattgtgggaggtttcttgtagaatgatggttttggtgtgcgtcagtggagagtgagcatgagcatgagcatgctgccgacgatgatgcagcgtctagatggcacacaagcaatggtaaggcgacgaggtatcagaacaatatgtcggtttgttcagccaggccgctccagatcagagaagaatcctggaacgtgcaagaatccaacgtgtcctccccaaagaacaagcttggggaggggggcggttcttgcatccgatctgggttgtgtcggacccgcggtggaggatcgatcaccgcttagcgtcaccgcagcggaaacctcgacgttcgccattttccggttctttcgtcatttctccaagacaccgtgattctccccttctatataatcccgcagcagtggtggccatgggcgatgggcagaagttgaggtcaactgtggcggacaatgtctttccaacaaagtgcgatcgatccattccccctcagctaaggactgcctgaagctgaccgtgacgaaccaggtgaaacggtgcccgttccggctcaatcctcgtatgccactaatggcctgatcccccttggttgttccgatagagggctaacgaactagtctagcctatctttcacgcagggattcttgcttgggcagctgtccgtggtgctgttgatcggagctttcatcaagttcttcattttcggcgaagcacctccgccgccctcccgcggcctttcacatcgagcgtctacccatcggcgttccaattctatctacacaatcaaccacaatgaggcaaataaccggtcattgagagagaagccgtcgaactcgaatgttctccgtccggtgccttcttcctcgacgaatactcgctctatcctccgcaaaacctactacagcgccattcccacaaatccctcgaaacatggcaggcataagattcatcactcgtcgcatcagccggagtctcttgactggttcaatgtgttgatcgcgcagactattgctcagtacagacagacagcgtacttgttgaaggactctccgacgtcgtcgatcctcagctcgctcaatgcggcgctcaacaatcccgagaaaaagccgtctttcatagacaaaatcaacgtcacggatatctcgctgggtgaagaattccccatcttcagcaactgccgtatcattgctgtcgatgaccccaattccgatggtgggaggctccaggccttgatggacgtcgacttgagcgacgacaacctgtcgatcgcgatcgaaacttccttgctgcttaactaccctaagccatgctccgcgattcttcccgtggcactgtcggtttctgttgttcgtttttcgggcacattatgtatctctcttgttcccgcatccacccctcccctccacaccccctctccatccccatcccctcccaccgctgatgggaactcacgcggcaagacaaccggggacgccaacgcacgagcggccgacgaggaagccgacggtcttccaccgaagaccgggagcccgaagagcaatgttgctttctccttccttccggattaccggctggacctctccgttcgatccctcatcggctcccggagcaggcttcaagacgtgcctaaggtggctcagctagtggaagctcgtgtgcacgcgtggttcgaggagcgagtggtcgagccccgagtgcaagtagtcgggctgcccgatctatggccgcgcatgggacggacgggtgtccgcaccggtgacgactcggaaaccggctcgaacgcggcatctcggagtgccatgtccgccgatcttggagaccaccacttaggggatcgagaacccgagggactacggttccgcggtggacttgcctcgcggcctcaattcgacagtgtgtcacgcaccagcagctacaacgtcgagacaggggacttgcgcagtcccagcttgatccgagaagagagttcaggtgcgcttagcgaacaattccaaatgcctggctcgttgtcgggcgcggctgctcgctgagccagctaccttcccttggttacgtgtaccatagataactacgagttttgaagaaaaagtatcagacctacataacgaacggagttaggtaaataggggaattgaacatcgtcatatgcaccaacacaaacacaaagtccatccatgaacgggtaatagctgtcataaaatttcattgccatggtatataacatagtcatcacatcaagctctacattgccacccccagaattatttaaacagcagcaacagcagccttacccagactaccgaggtaagacacacggtgcgggttctcatccagttcgttgctacggttcaagggagtccacttgggttcctcctggaagagacgcatagccttgacatactaaatccagacccattagcacccatcaaaaacaccacatccccagttcacatgtacttacgttcttctcatccgtcgtaaagcgatggtagatacccgcggggagaataatcagatcatccttcaccaacttaatgcggacccactcgtcctccttgccacggacatcaaagtatccctcaccatcccggatgtagcggatttcctcgtcctcgtggagatgttcgtggaagaacatcttcaccttctcctcgtacacatcgcccatggtcttgggggacacggtgacctcatcgcggttcttgtatccgcgctcggcggccagggcgtcgacgtcctcgatgctcgggcagtacttgtagaagacacccagagaggcgaggtaagcttcgtcgacgggacgaccgtcgtcgtggggttcgcgctggtcgccctgatagtgataagatgttagtatgccattatggtaaccaattgaggggtaatgaagccatgcaggcggggggccaaaggctaagcgggatagattgtatagactcaccggcttgttatcgtaccagtaagccttcattttcaaacaattctaatagatgcaaacgcacacgaaaacacacaagtcaacaagaatgacaacgagaacgaggatcaacggcgaatataagtccacccaaacccaataaagcagcgcggggccgtgaaataagcccctcgtgtgattggctgtaatgcaaaacttcggctcatttcgtcattacgtcagcaaagcacatcatctcaccgcctttcggagtttggcccggatttaagctttttgcttgtctgcacgtgatgcggacatgagttcttttttccggggcaaaaaggttaatctatggattagtttagtagtgaagtccggttgcggaagcatcagtttctagcttctcccttcccctttccaccccttaacgctttaggccatctgtttgcaatggcttttcgggctcgctccgtcgcccttcttcgttgggggttggagccgagatcatcccagctgagtgtgctgggtaggagacgtgggttggcgacagtgtcagatgggacgcggtatgtttttccatcctgtacgtggttttctttggtggttaggtgctaattctggtttgttcacagggcatatgatgtggtggtcattggaggaggccatgctggctccgaagcctgtgccgcggctgctcgttcaggcgcccgaaccgcattaatcacgccctcgctatccaacatcggtgtctgttcgtgtaatccgagtttcggtggaatcggaaagggtaccatgatacgagaagttgatgcgatggacggagtcgcgggacgaattattgataaggccggtattatgtttcgcacgctgaaccgatccaagggcccagctgtttggggtccccgtgctcagattgatcgcgatctgtataagaagtatatgcaggaggagttgcaggggacggaaggattgagcatcgtcgagggtaaggttgcggatatcgtggtgtcgaaggatggggtcgagcatactcccggggcgcagggcaagattgttggtgttaggctggagtctggcgaggttatacccactggcaaggtggttatcacaacgggcacgttcttgggtggggagattcatattgggcttgaagcatacccgtctggtcggatgggtgaagctgctaccttcggactcagtaagtccttgcgggatgccgggttcacgttgggtcgtttgaagacgggcacacctccgcggttggatagaaagacgatcaattttgcgcctctggaagttcaggagggtgatcaccccccgagtccgttctcctatctcaatggcagggttcaggtcgacgatgaggcccagcttacttgctggatgacctacactaatgacgatgttcacgatattgtccgagcgaacctggacaagaccattcacatccgcgagaccgttaggggccccagatactgtccttcgctcgagtctaagatcatccgcttcaccgataagaagcgccatctgatctggctcgagccagagggtttcgcgccaaacgacgtcatctaccctaacggtatctccatgaccattcccgccgatgcccagtacgccatgctgcgaaaggtccacggtctcgagaacgtgaccatgcttcaacccggctacggagtcgagtacgactacatcgacccgcgcaatctccgacccacgctcgaaaccaaactcatcagcggtctctaccttgccggtcagatcaacggtaccaccggctacgaagaagccgctggacaaggtatcatcgctggtaccaacgctggattatccgcccaaggtcgggaaccgctcactctccgccggtccgacgcattcatcggcatcatgatcgacgacctcaccacaaagggcgtctccgagccctaccgcatgttcacaacgcgaagcgaataccgcattaccactcgctccgacaacgccgatctccgtctcacccggatggcccgcgaagccggaatcgtctccgacaagcgctggcgacacttcacggaaacggaagcgcaaatcaacgagcttcaaaccctcctcgagaacaccaaaatgtcctcctacgcctgggctcgcaaaggcttcaaggcccgcatcgacccctctcaacgctccgctctcgacctcctctgtctccgcgagagcgatattgactccctcatcccacatattgagtcccccaccggcaccgtctactctgcctcttccttccctccggagatccgtaaccgtgtctccattgaaggccgctacgctccctttgtgatccgccaggaaaacgcagccaagaaatccctccgcgacgaaaatttgtctatccctgctgacttggactatgctactgttcagggcatcagcatcgaggaaaagcaggccctggagcgcgtccgtcccgtcagtatcggcatggcgaggcgcatcgagggcgttactccgtccggtgtcctgagggtgctcatgcatgtgcataggaccagtagggataggactgctgcttctgctcctcctgcttcggaggggcttgaggagacccctgatgatgttatcagccaggcaccttgaaactggcggatagatgatcacgtgtttgtttgattacggtgttggacgacggctatactatactattgcatcacagcgacgggcgaatcgagtcgactggactaggcgtattggtgttatttctggactcttagaactgaaaagatggttggcttggaggccctgttatgtatattatacctttcatatcttattttcgaggcctatgtatattatacttttctctgtggatctcggatacgtgcatataccaattcatctctctttttgtctgtttcttcagtgagcgatcgattcaatcacacggttcgtggtgatataacgaacttagtctggattctgtatccgacccgtgaaccttacatcgggtgatgggttgttgttgctactgtatactaattgagaaacaagatgataaacaaacaataataattaattcacatacccctagtagccacgttgattacctgacgatattttagataaatacagttaacctagtatcaataactgctggtaactatttacaactgtagattactcttataagctattgactgactatctttgtactacctatgtatacccgatgtttggtaacagtctaattttcattgttattgaattaacatcgtaagctgtagtagagatcctatcttcaccatcagtaggttcggtttgatgtgggatagttgtactctcatcatagtaccgatctactcggaactgcaaccgaatatatatctactgccctctacgctctaccgattgaactcaaacatcgacatcgaacgccaaaaccaaccataccgtgcaaaatacaagaaacaacacaccaaatgacaatgctctatttatatatatatacatacatgcatacatacaccttctcacacacttcatctacgatgcgataactatgggttgggttaatcaaggcttcttacccgccgcggcgcgggcaatgcgcttctgcacttcttccttggagagaattttaacagcgtccctggagaagacatagctcaggccagaccagagggtagttgcggcgacgaggtatctttttgagtaattgttagtacgaccaaattcttctgcgatatttcgaaaggaaaaacagaagcgaaaagaaagagagaaagaaaaaaatagaaaaggtaaaagaataaaaacatacaacagaagggattcgctggtggtcacccacccaactactaacctcccggcgtgtggcttaagtacggctgagcggacgggaagccctgttttccacaccctgtggtcgtatgtaccagacaacttccagaacgggtttacataggcctcttcccgcttatgcacacacacttttacaacagtgacaggataagggtaacaataactgggggataaaatgggccacttactggaatccagtcattgcttccctcaagctccaagcgtcgatgatcgtctcgggaagtacaggaagcgcaattgcactaccaactaggagcagctgcagggccgtattgatcttggacacggtagtgggcttcacttcggccgaagggagcgaaaaatcccaataccgggccatggttttgggaggtggcagggatatccaccgatagtagatggcggaaatggctagtccgacgtcccgtcccaggatgattacagcgagccaaactgggggttgttagccaattgagccgaaggttcgtcgtcagtttgtgccatgtggacacaacgtacctgggattgatccattcaccgcgagacagctgactccgatggtcatgagcagtttgtcagccatcgggtcgatgatcgtcccgacaactgtctgcagattccatcgccgtgcgatgtagccgtccacaagatctgtgataccggcatatgcgaacagacctagtgcggctacgtgatggtcatggacgaggaagtatcctaccataggcgcagcaagtagacgggtgaaagtgagaatattggggacggtgtaaatattctcatgtgtccgaggcagtttggagagaattgcggactttttggagctgaattgacatatatcacacggttaggtttcgggaggggctgataacagagcgcagccctcaaatggccttacacggcctgacaggcgtgataatagagtgctcaccttgaagagtccggattagttggtttctgtgcggagtatcgcttttgttggccaacacttcgcgccaattgcgactctatagcgcaagaaaggctggtcttctttcgtaatgggctggaccttgatttagcgacttctcctcacggccatgcttagtcaaatcatactttgcctgaatcctcgagcgactgcccagagtaattgctgagaagctgcgtgcttctgttaccgacgtctgccatactcgctgggaaaggggagcgctccccaacggagatgtgaacagccgagtgcactgcctggatgcacgtagaggcgttgggatcattgcaatcgctgccatgatgaagatcgtaagtcggtagatagtggaaagatccgaatgatgcccacgcggtattgctcagatatagctggatataattttggcagatagtttcgaacaggcaatgctttccggaagtccagtagatagaataaagccagacgatgcgattcaattggtgccaaatactagcaaatgacaaacgtagtcatgtcatagaacaatatctaacgttctgaccgtatgaccacgtgacatgggagaaaagtagccggaaggagagaaggcgagatcgtggaaacgaaaggacaagccctgcaaccaacactcaatggcgtcgcttgaaaccaaggatctgacgctgttcaagactggaatgaacgaagtatactactgtctgaacggccagattatccggcttccgcgagactcctgggcacgtgagtctcgggtcaggcggcgatcaatcccactgacggaataattgccatccacgacgccggacgatgggtgacacgaggcaatgaagcgcgagaaggaccggatgttcgacaggaagcgaaaggggaagagaaggagagtatagacctcggtcgagactcgcgatgggagaaaatgccgacggagttttggttcctccgaggtcatgtgactgtatacagacatggcaggctggagttgccatgagcgaaacagttcatgatagcaaggttgaatggcagtaattataatagagagaaatacagaggaagaaaaagtgtgcaggtatttgttgtgtataagtggctcgactagtccacctatggtaatgtactctatcatgcgaggaacattttcgggtagaattggcgcctatattgtatcaatttgagattattagacataggaaaagacccacaccatcgtcagtggtaaagtatatcctccacagttcctactaagaccgggaccacaccaacaggcttgacatgtctttagatttaatagaactgcttgcgcgcgaatcccgtcccattgcactattcacggctctgttcattgctcttaccaaggacccagagtaaagctaggtagtatgttggatgcatgagggctcatctgctggaagttcggatacaggggtgccctgagtttccgctggcatagccgcttcgcatacagacttagcagggctgctgagtcccctaatttcctctgaaggatcctggattatcggtccagaatcagccgatggctcttcttgtcctttccgcctgagacaccggtataacgcagctgcgaccaggccgcacccagccacggctcccacaaccggcccggcgatccactcttttgaaggacgtgattctgaagatgagctaggcgaagaggcagcggccgtagtagaaggcaaagcagtagccgtggggacggtccttttttgggtctgcgacgtcgtcactggagttgggagcttctccacaccggccgtaattaataggttgtggtaattgatttctgaagacttcaacgtcgtatggcgcgttatatgtttggacgtgctcgttttggggtcagaataccagtagcttgcataaaactcgcaggatgcgctttgggttgaagaaacgattctgcaggcccttgaatcgatatcgatagtgtactgctgggaatttcgttcggagccgcttgagctgtgtatgtacgttgaaggtcccatggtaaacgtaggggggaaactgacagtctccaacgagcagttagcgatcaggctatggatacagttggtcccgatagtagtccggtcctccacagtatccacatccacaatgcttccagccagaaaactaaagatactgctgtaaagcacggcgtttgcctcgaaaacttgaacatatgctgttggaggtgctgttgtgacaactgttgtcgtcgtcagcctggtggctgacattgccagtataggaaaagcgaccatgagagcagcgtatactgaagacatagtacacttcatactcaaaaagtaatttgaatataaaagggtactaaaaacgagtcggaacgtgcgactggtggacgacagatgttcatagatcgcacaagctttgtgcccatatgggatcctcctcaagcaagaacgtggggcctgttgtataattgacagtcaaagatgtgctttatatcctgctttagaaatgaatggagtgagtcaaggaaaagagtgaggaggaacaaaccgtgaggaggcgacggtggctgatgggtaaggtgtcacgaactgcccctgatggtgcttgtacagctggataccccacttgatagtcaagtttatcaactcgactacctggcaagagctcaaaatacctaccggtaatcctagaatttgcatcctctgtaggtttttgtagaccaagcacaccgagcgttgttgctgatccactcagccagcaggacttgagtggactatagatggcccctgttgtgggagtcgagcacatataaaccatatctggtggaccaagccatagcagtcatgttattcagagacattgatccgatagtcaggtttaagctttgctattctcagagctgcttggatcatggtcgggctgttggacgtatgcgaagacgcgaagaggagaggagcgggatcgggatgtcacccgctaactagtcgaactccttcgctgtcaccctcagaactcacccttttcaccgagcagcaggtatcttgcaaaacaccaggcttctttacttgaccctttatcctagagctcatacttcccggacctactgtcagatgccagcgtctatatcgaatgaatgacccctggcaccactgactggatcgttccatttccatgatggcaccttgtctcacgcgagtcgggatgataagagtctgtgtcacagctctctcggtctgcctcgagaagcgtccataatatgttgggaatcatcggtggatcaccattcctatacaagcaagcctcagataaccgaatccgatatcaaaagaggcctctacagagtggaaggaaagatacagctcaacaatggggtctgtcgatgacttcgcttgctcagcaccgtctaccatttacctggcgctctataggtgaagaaagaacctatttaatgaagtgaggttagttcctttatcctgagagctatgttccctgcaactacaggaaatcctgcaactatctgaagctaattcactaacacaactattgctttcagcacttcagaaagctagattttgagtgttacctccagacttgacccggttcgttcgaacatacaaaacgtttgtcaactcaaccgaacactgaaaggcatcaatcgctttcgcctcgtcccagacgtaacgaacagagatctagctcccttttaagcggtcgatttgcacaacacagaagcggacctttgggtgcgtcggtgccataatacatcttcgctgtatttctcggctttagggcaataaatgggagcctatgatacaaggagagaagatatatgctgaactttgggctattaagaatgctgtcgcacgctggtcagcctatactgggatagatctggcaagacaagtgcatgactttggcactcacatctgagaacttcaccgaactgtcattcagttgaaatattcatcgaacgtgagtcgaatactgtatcacaaggagctttatacgtcggggttatatccagtgtttccgtgcatctccaggtatcccgctaccgaatgactcctaatttccattgaggaacagacatgatggattagactggttctgacatgccagatctagcttaatatcacaccgtgtgccgattcagttaaaccaagctgtaacaactatatcctactttgatactctatcttgcaccacaaccagcctttctcttgagttttctagccacgcatataacgtactcccatcatatttaatcgcatgttatgattagatgcagctcactacttcctgctaccatcaaaaggtctatcactatcatccctatcaatcccctaatatctacctccacaccgcatcccaccaaatatcaccaatagcgagcaagtatatacatctcaaacagcacgttacacagaaccccccttatcacaacccaacgagcacttcatcacgaataatcagttcccattctctcaccaagcaagagaacttgagactcatcgtttatcgcccatgacacacaaccccaagctccctatcccaagaaaacacagcaacacaacagaaaccacaagccaagctataacccacacacccggtccacgaagccgaaaccgtacttttaggaaatatagcaatgcccaatgtgtcacataagagcagtttatcattttatcaatttcgattccgcccatcagacctccgcgtagggtctggaccattacctctaaccactccacaaccaccaccagcactatcactgacgtagcaaatccgccacaagcaaaccagcacggtataccggccaatggcagtaggacacaagttattgatagcctcgtttctggtttcgtttcttcttgttaatgtccatggccatgtccatggatatactggtcggcgtagtgatggctgagacatcagccctcactattgaaattgagtcgtatatgtcttggatgttagtgtgtgactgtgtaaaaatgtgtggaatggttgatggtttgtactctcgcaatgaactttatccgcagacagatcagatcagatcagaatcagatcatttcttgggagtacgcgtttgtttcagatactgaggtcaggtggactaggatagtagtagtagggtaggttggtttctgagacataaatgagtctctggaaaaggagcaataggtcggtctgaactttagttcaactcgtaagaggcttgattgtgttatagtcgggtatctatgcgttcttggtgatgggttggttgctctattgatgggataatagtgatccggtacaattaaggggttggtagtaaagtaacattttcaccccccacaagcaagcaagcaagtcctatacataataccccacaatatccatactaaatatgctacacatatacatacatagacacccaagtaactactaccatcagacaagatcaccacttccggggcaaaatctcatacacatctatatagggtaatgctagtatagaccaccaccacttacacctccctagcttatacacagaccgacgcccacagcgccaggaaaatatatccgacgcagttcacacggaagagacaaactctacttcacccatacatccccccccttaaattcaatctatacactgcaccttacatacccttcccgttcttcgtcttctcccaaaaccagtattaccagtgacacaaacacaaacacaaacacaaacacctcgtgttgatactcacacaacatgcccctatgcagaaaagccccgatgatctatcaatcattcattcattcaaatgctgaagatggcacaacatattccttccagcaagggtatcctaatcctttcatttcctgaattggtctgttctgaactgttctatttactgtatgtaagcaaggtaaaatagcttcataggcaatagtccagaactctacgggagtctgtggcaaagcaaatcccagcacgagcgcagcacagaacagcactcagccacattcctcatgcttacctgcccaacatagcaggatgtcatcagccatcatgccaggtctgtctgtgcggtgaaaatgacaaaaaggaaaaggaagtgtaaggtcttaaactttacttgccatgtaattgacacagccatcaggcacacacgtttacattcacattcttgagatgggggaaatgccgacagatggcagatacacgattttacttaagttactacttaggttgggaaatatgtacattccacggatgcttccccggcatgtacatggtgatcgggggaggggaaagtgtaactagtagacactaggtgattactaggaaggtaagatgaatagggtatacgtaacttaagacctaacacatacttagtatcgggttaagaaaaggaggaatatggaatggaaagtgaaagaagaaccttgcagtttttacccatggggaaagaaagaaaacggctctaccgtgtctccgtgtactccgtacgtaggtatgcacacacagacacatacgcacatagtatgcagtacgtgcatagtaagagacgatgcgatctgatctcatgggtggatgatggatcgatcgggttgggtatccacacaggcaacgcaaccagatctacccatctatacctaatctaccttggcaggtaaggcaagggttgaaagctctttgcagtgtagatctagacgacctataccaagtaaaccaactgtcacttcttaattcgtcagcgcataacttcaccagtaacaatcctgaggtaagtaagtagaaggtagagtagatgatatgtccgatctccatctcccctccccacccaccctgtctcgggtctgaagaaacccgccacccccctcgaaaagtaaaaaactgggaaagtagaaaatatttgaagatcccgatcatatcccggctggggttaacttaccgactttaccccttgcattgctgttttttcattagcacgctatctagtattcttcacagcgataaaaacacctgacaaaatgtaggcaagtagttattgacctcgcttagctgggcatcttgcataccatatgcatagctaccgtctgtcgactgcaccttattaccgaagaaagccgtgaaacctgactttggttgccgcttcctatagccggctgtgtaagcactgtagtgatagccgaagaatgtccgtgcatctggtatacatgtgtagcagaattttgggaagaattgtctgtgtgttgcctgccgtcttttgtcttgtctgtgttcccattggaatagtacgtaggtagaatggattgatcatgtttgcgtcaaagtggtcctggatatgttggtcatggactagtaagtggtggtagctatccaacccacatatgtaaccactatcggcagatatccaccagaaccaaggaaggcaggtagataactaaactattgacaaagcaagccattagccacacgatacaacaacaatatctgactcagtagacgaaactgggaattctgcaccatactgtaccaggcaggagtcttcgtcctctcttattttctccctcccgaaatccgcacccgagatgctaagcagtccagttagtatctgcaggatgcatttccaagataagtatgagcatgtcagaagatccgaaaaagaagtgcgaagggttcttcagctgagcctcctcttcctgtctctctctcgccatcatctgcagatgcgagcgagcggggcaagaagagtgttggcacttggcaggcgagaagtagtgatgtatgctaggtgtaagttagtcagttcgttgtctgaataactagacaaacagtaattagttatcttgtaggttgtaatgtaagtaagtgatcaggagagccgcggtactcggtgataactactacttactgtacggtgtaatacatatagtacctgcctaactgggcaattggtctgttgagcattgcttaagtgtccgtttcaaagcttaaaggattagaactcctccgtatttagttaagaagtaaagatagtagacttaatcttttatctaaataggtgactttttgtttttcttgtaaagattatgacatccatatcagatccttcgataaacatatagatggatagataacccgacagggggaaggatagacaccacaacgaagtgaaataacaaattacggtgaagaccaccacaccaccaccagcatcatcgtcatccaaatcacaagattcaacatcctgccccgcgcgcccgacgaaatactaatcataataataataactaaccaaccaactaaccgaataattaactgcttagcaactagttagttagccggccttccgcactccgtatctagtgctagatacagagtgaaacaaatccccaaacataccatgtcgatctacatttagcagcgccccgaactagtccgcaaccagagacgcaaagaaccagtggctcagacgctaaattaagagggaaaaaaaaagaaaaaattgcggacttagaacccatctagctagtctagtcgttcacctaataatacatgctgttaatattgttattaatcactgaattgaaaaaaagccgcgatgacgatgttgccgctcgctgccgctgccgcgtctaaggaaaaaggaatgagagagagagagagggtaagaaaagccgcccccttatcggatgtagaggttcggatattctggaactagtggcgttgcgctaggaatctgattcccagactttttcttttgttttttcctttttgtttttatttagtctactgtttacaacatggatgctgctgctattttcatactgtctacttagtaactagtcagcatgaatccactggggcaaagggaaaaaaagaaggcaaaaaaatatgtaacaagatgtagtaggacaaggtaagtacctacgcaagcggcaacgtcttgtccgtcctgtggtatgatatcgttgtgcatggcaagtgtagacctgattggatggtaaacggacacatggacggcggcggagtacgccgtgggtacatatacatgatacggacatcttaagtactacacaaagtaggtagaacaggaaagtaagtatgcataaggacagggtgtctacctgggtaagttgtacaaaacccccatctacttactcaagatcggtacgggagtgggagtgggaatgggagttaatgtgtataccctgtctatactagtatagtaaaacctcggaaataagaacaaggaaagcattactagaaacttgaagcagactaaactaaaaagtaactaaccacatgcctgtctgcctagatagtagtctagtttagtgtcccgagcaaaacccctcaaactaagaaaaaaaaggccagggactgaaatcggaccggccggccatcagtaacgaaccggccccagcaagaatggcaacccgtcagcgaggttggcgcgccaagtatgacctcaataacagggggaaaagggggcaagagaagggaaaggagctgaaatgagggataagcgatgaaaacgaggtaggtaacttggctccgaactaaactgctaattttcatctttttctactaacgtaggtaggtctaggaaggaaattcttcgaaatcgtcataggacgaggctgatgaatgaacggaaaaggagtgatgtctcgaagctgtcgcagaaatttccgcaaaagtaattaaaaaaattttaagacacgcgccgatggccccgagccacgttttttctggcatggtggtggtgctgctaaactgagtggtggtcgggatctggatccctggctagactgtgggggaattcgcaggtggctagctatattactgattactataaccgggctagtgactattagggatgggtgtacctggtctagttgcatagttttgagggagtggaaaaaggcgggatgaagggggcaaaggcacattacggcaaccatgaacaaggctagagatgtaattactactagtatgtagtggtggtgtcgcggtgtgaagagaaggaattggatcgaaatacttggcacttgcgctggcagtagtaagtagtaagtagatggtgatgatccacttcgttcccctccacccatcgacccaaaagcgtggctgacaaggcgtccgagcaatgcagttttcgttaagaatcaacgtgtgggctgcgatgggaatgagccggcaggaagaaccagcaagtcatgttgagagtctgaagggaggaaaattattcaaaatgggaagatctactgaaaattcacaagaaattcaagagaaaaaaaaagaaaagaaaggaagaaggctgaaagaaaaagaaaaagagttttgacaagcaagggggcggcttggtgcctagaaagagatctagaagcttgctcaaaagcatctagggatgaaaagactgtgcgaccgactaagtagatactgccttatcggaatggggtacatgcagacgggcaaaagcaataacaccgctaccatagaatgacgacccaaactgaaaggcgatattggttgcggtgtgagaagtggcatgaatgggccagagggtgagcgactagtaagagcaggactagtccttccggctgaatactgggtcctcttccatgtgcgcggctggggtcccttagtagttagttacttagtaggggagggaacattttttggaaaattaattcgacgattgtgatgtgcctaaaggatagcgctaaattcgtagggtatcgtcgactactatactatctatggggatcaacactgcatcactggaagccactaatctccatggcttcgtggttagcagcgacaagcggatgggcgactaggacttctcactggacatccggacaacctcagccagactacgccggagttggtcaagccaggttacccctagctattttgcggtcaattgtgaggatgagccacatggtttggaaaaatagtcgacatgctaaattaaaattaatctaacatctaccgagggcggacgctgcatggattgatgccaaggaatagcatgattgttggattattgccgagctctgaacagaccagtttgatgctaactagtagattcatggatgatgatgacccagtagatttaaattaccacggagttatttaggggaaacagtgcagcgtcggacccgagacgatgaggaggagaaagggaggaaggagatggtgagaaatggcgggcgatggagactctcaagaagagatggtcatggctgatcgacatccatgatccatcagccgtaactcaaaagcccccattccaggttggtgcccacagacaatgggcttttccaatcaagacagcctgagcgtgtgtgttacaatcctcatctgggtattgcatgaagcaagctcctgattaaccctttccctgaggttgtgaaacagaggacagacttctgacaccagcaggtggcctagtctagcgtcgccctcatcctgcagggctaactaagacggccgaacggccagaaagaaaaagtgatggaaaaaagaagaagaacaaaggaaagaaaagaaaaaaagaaaaggaaaaagaaaaccacgacaggtcacgtcgctaaccctatgaccagtcattcctcatcctctattaggtatgctgatgatattattccggctgatcctcgaagagcagtgcacacaagggatggagtgtgggggttcgggtctactgtacctgctactgtacctgctactttactgtgtcatgtattatgctactgtatcctcgccttttggttgcctcgtctttggggcacggacggtgtcctagtcctgatcctcctatccctgattctattgctgggatcaatgtcccggtggatgaggtcgagtcagtccactacagcctacaggatcgatcgcatgacgaagcgcgttgcattgtgtgtcccgctgtgccaaagagagcatccccgatcggaatggctggtaggggtcaagagctaaggaagactagtgagcggttgatggctttgccaaagcgtaccacccagtaagtatcccgtgggatctccatcctgcgtttattacctaaacttgtgccggagatagcggctcgttaactagtagtagtgtttgtcgacctttcaacaagaataaatgcccagctgggctagtctgtctaattgattagtgtagcatggtcgaagagtgactgacagaactggttttttctccgcatcgaaccattcacgcagaaatgaaggcttgggtcatgacccgttttaatggtggatgatcgtaggaaagacgtaagtaaacagcgcggacaagcgctatccggaactattgccatcggtggatccctcgttggatttaggtcccatgtcctgggagcgcccgaccgatcgccgtaattggagattcgctagagcctagaggaagtcattccgaaactgattatcatggacccccttcttattcgccagaccataagaaaagggcctctggttatcatttcccacttgctcgaggtctccagactcactatcccggaggtggaaggcagcaaagcacgtccaaacctcgtaaacccgatgcatgcccttctcccgattttcggatgattgccaagccagcgtgctggatggagtagtagcctagcagtaaaagtagcaagtcgggtggataccaggccatgtgtgtgactagtagttcgttgatgtacgacgtaggtacaggcaggccacttttgagagaggggagaggaggagactgggggaggaggagatgtgggtgttcccagtatccaggttgaggggatcgcgagagatcaaggggtcgaagtatgtatctacctacctacctaaatagtttaacccgcaaagacgggcatattggtaacaacacctctatggaaaacgatcccgtcacagttggaagtcgactgcatgatgagccacctgacaagtcttatttggggggggtgatttggaagtcatcctcaggctctgtagcaccccgtactggaaaatcactccctccctcttcctcatccaatgagaaacattgaaatgcggtccttttccccggccgattggcgccctttttggggattgccaccatgatcaaatcatattcctacacgagctcgaggcgtggcacagtgcatccaagcttatgcaggataacatatctgggaacctatcatcagatcagttcgcggctggttatccatttcagatagacctcaaagcgtctggcaatgcgcaccgtgcgtggccaacatgccgtcgccgtcgccgtcgccgcccgggagggacgggcaaaagtgggcgcttagtccccttcttttttcctgtctttctttttgcatacgtataactagttaagtactagtagtatgaaggggaaagaaatgccccgtagtagtggcgttcgcggaaatgaatgaagagggaattgcggtcactcatgcatgcatcaagtgtattgggatcgttgagatgttggcacacaggatttcctatctcttctgactactgtataatccagtgtaggggaatacggaggacacatagcaggagctcccctcccattactcgaataggccacttgcgttaagcgtgcagagggggaaaaaaaggcaccgtatcctgtgccctgcatggattccgattcctgattcccggatgggaaatgccactgacatctctccatgatttcttcacacgcgtgaaagagatttaaaatatggctgagtttaagctggatagttattgaatccgttttatgatgaacttagatatggtttcaccagctgtatgctaatctttcccctatccccaactctttattttcttcttctcactgacatcccttccatcaaatcttggaatggtacttgatcagccagagacccatgtaagtagatagatagttagtgcggtggtctttctttgctgctattctattctagtattccagtggactccatccagtctgtggtttggaacgggaaccaccttcatttaattacaatgatctactatacagtaccggctagtactagttgatactagtggggggtggttggtaacagcgaccaaactcgtgtctgctgcttttctacttacgtcgcctccccgttctggcctgtttggttcgacattcttggggaggggggcgatgatcgcctgttagatccagacgaccctgtcattgtgcggcatttcttcttctggtcggtgggcgaaatgtcaaggatagcgccacctgccgcgtctgctgtttctgttgacgcttcccttttggctgctagtccagttttctctctttctctcactccctccctccctctgtctccgtggaatcgagcacctgataactgtactgtatgtaggatgtatgaaagtaggaataattactaaatacatacttatgagtaacagtcgtgactgggtagatagccattttccccgtttggtaccacttttgataccctctactagttactactattatctgctaggacgatccgctcagacaacaacctacttacttactagtcgtctagcagcacctctccttctcctccttctctcctccgacaattcgcctgtccttgaaccccatgtcccccaatcaccattcacatggtgcctgcccgcgttacctaaaaggggaaaaacccaacttcccggaccggagcaagaccttccaccgacctaactaactaactaaccaactaactaactagccatgacccaaaccacactctctggtcgcgttcatttcctggcccaggtctacggttcaccgtccgtggcgctactggatgcatctggagccgggcaaatcacctagcgcgctgtctcttcgttttctttttctttttccttttttattattattatttgtgcgaatcccctctgttgacttccccctctggtctcgctctcgctcaatctagccatacatagcggacatgcaacaagggccacattatctactatactagtactagtactattactcaagaacgtggggactttctaacattgtggaatacggagaactagggagtccagtgactcagattcagtggggaacaagtaggcattgccagcccagaaaaatggcacggacactgactggatcctgggaccggacccagaccggtcgggtcggattcgttcctcccactcgccttggatacgaagcagtacacacgtccacgtaggaaggagagaaacatgcctgtttagcatatcgaatcatctgccacgcaatcaaaaccattcttctttgcctgttaggatgcagctattacctttgaattgcattccaagacataatcgcttcaaatatccagcgactaacgacattgatgttaaagatgtgtcattctatggggttatccgctctcgctccaatctacttttctttttcttcgctctctctaaccgaacccgtcccggggcgctggttcggaatacgaggcatcgttacccatcagtaagggatgatggccaactaactggagctgtaggtatgggccgagctatatgcctcctagttcctgctggggcaccttggattggacgctactgtagagttagctgatgaatggcgcaggacccctagacgaccaacatagcatagcatatggcttgagagtctgtctggagcgcagcaagtgaactgaacatttcaatttatctagggttgcctcctgctttgggttgctgatcatcgagtcggcttaacagggacttttatcggagtttcctggttcaagtagacttttgttaccagtcaccgtgtcgtagtagtacatgaggtgcatcctcacttgaccagcggcccatgtatgcaccaggcacccaagagtttgatctttcccccggtggctcttgcagctgcatgcaatactatatgtatgggtcctctctcggtaaccatttgagtttctgggtatagtaagggcttcctggtcactaccaaaatcccgtcagacaggcaggcaggccggcaggcacggcttgtatgaagccaagtctgttgcagcttcctagtagctcctggtacaggatggattggctgtacatccggaggtcacttctccaagatccctttttttactctcggcctcaatccctcatcatgctgtatctccactaactcacatagtgcctgaggctccagagcaaaccgacttagagtttcctggcactgggtctgtcattgctggcccaccactgccaccggaggaataaatgtcagcaagccagcaagcaagtcaccaccggcctgtcaacgagggttacctgacgatcaaaatccaattcgcgcctggtaaatcgaagaatagtgtgatcgtccactgtggtagagcctattgtaaaactagtcttaatggatgctttttcatcttcccccctcccttccccgggtctttcagcgtggaattgagtttcgacaagcacccaccggtgcgatcgtctactgctcacccactttgtcgggaccttactatcggacctgtcccttaccacccggtctagaaggacgatctcctccctgaattgcacctgctgttgaccaagatgagctgcaaaaccatgctagtagggggaaagaaaaggtccaagagtcgtgctcgcgcgtctgtcggcgcttccgtgggtggactcgccgggcaacgagaagatagctcagattcacagccccagcagcagcagcagcagtcgcctatgggcttttggatcttctggggatctcccgcgaaagttttggcgacggtccaatataagctctaggaacggtgcccccctgaatcctgacaaagttaccgacaattccagtcgattcaactctaaaatgtttagagttgggcagggctttattggtttttctcctagcgacctagtctggcccctactgctgctttggcctgagggctctttaagatgatcgccgccgtgtgggacgcttctcttccttattgttccgctcagatttccttttattattctgattattattattattgcccacccccttccctgcaaccagtctccacgcccttcgtattcgagcgtgcgtggcttaggcacggtatatgtcatggaggatcatgaccataggaagagaaagctccgcttctgccttctttcatcccgatcgaccatccccgggggatccctgctggcacattggagcaaagactttctgcacggatcccgacggagcctgactggaaccgtcggccggcccagtggaagacctcgaacccagacatcgaagctgccttgctgatgggcacgttaagtctttttcttctctatttggtttgttttatttagttttatttttatttatttattattcttttctttctattttcacccccggtaagtcgatcaacggagcacatgaacgtcactggtcagtcgcaaccgtggagcaggataacgagtagacgggcatcttcttgatctccggccacagtggcgggagcgacgcggaggagccgaggagattgttgagtgaaagtaggcagactggccgagaggaaagttgacgcggcgcacagtcctcctcttgggcatctggtcgtcatgcggttccgtctactcgtcacaggccaccacgggttgctctgtcgtctactggttatgtttctatgggagctgacgaaaccagtcgtcttttcgtcttattgtcgagagggtttctattgggttggaaataggtcaccggtgcggccgggatggatcgttgacgactaaaagtgcgggtatgatgatgggcggtgatgatgacaaccgaggtcatcgatcattttcattcaccactgtccatgtgtgtgtgtgtgtgtgtgcgccatgtttctctttctctcggcttttccattctccctttttctttgtgcctgccatttctatcatccggtaagtccttggtttggtatcataatcatgagattagtatgaccccatagcggatttttttttgtagatgtacggagtacgttgtgatgtaggctggataatgactacgaaggcttagatgatttgatcccgagggaagtcgggagaggataagagaagagaaggggagctactgtgaaaaggcgcgcgcatatgggccgcagagctcggaccgcgtttgccagattgggggagggtcacgaaattcagccggaggaagccccagagagagagtgtgtgtgtgtgtgagtgagtgagagggaggatgggggactggagcagttgctggtcgagcgcattcccgattcgatgtgtagcaatgggatggatgcaagttgctggggcgtcccaaatcttctccagaccctctctcgctctctgggaccaatccgaacgggtgccgccttgacgccatgcaataatcacccgtcctctcataaccccccgagatctgagccctgggaaggaaggcggccgtttgattgagttgtccttttgtggtcattatttttcttttactttctcaccccttcctccatccgtgagctaagttaggtatgtcacggggattatggttgtcttacagtttttttttcaggaacctgatgtttgattaataactatgacgatagatgagggcagggtagtattgagaggggaagtatgttatgtgtgtatgtaagtagttatgtaagtgactatgtgtgtggtgttttgctggggcttactaaagatcgcccactagggaaatattaggtaagttaactagctgaatggcagctgctcgatgacgatgtgaaaatgggtgatgatttaataatgcagaaacaagtccatggaagaggagaggaacaagaagaatgtccgaccctacttactgccatccatttttacataatacttcttttctcttctactgctgccaatctggttcagtgtttgtgtgtggtgtgtgtgtgcatacactatgtagtgatagtagttagtataccatgttaataccattgtctgctatagaaaccaccccagtacatatacatacaccagttactttaccactttacttagatggtacagcaagtagagatagttagttagttaccaaagagccggtcgatcgactctgcccgaaaaaggcaaaagtggattcttgacttttttttctgggcctcccgatcaatgacttgaccggtgcacatcaaatcaaatcgactctcttttcgtcaggggcggagccgtggttggatgactgctggtgccccaccgctgcagccaacccctcaatcagttcagttccgatggggagagagaatggttgatggagttggggttttgtgggtaggagggagagagagcgcatcatgggatgagatgggttcatggttctacttactacttatgatcaggaggaaacaagaagaagggacgagaatcaataatacataacacaaaacatgattaggggggtttcatatgacgttcttgccaattggcaggtactcgtgagtaaacagttacaaaagaatgcggagaatggcagacgacccgataagattcctcaaccattgtcgatgctagagaagaaatcaatcagtcaaccagttaatcgcccgcaacattcctgaatccattccctcttccccccttctccgctataggatgatggccactgtaatgaccacccggtggatatcttgacaacacttcatagcgctccgccccctccctcctcctcatcctcctccatcgagtggttcaggcatcgaggcggtgggatgggatggtcatcccgaccgtgcacggtaattgagccgccaggaatacacgctcagatgtagttagttagttagttattagttagtagctctgatcccatccctcatggggcgtctgtcctcccctcgagttatttatttcccgcctcctgtttttcccctcccaaaagaggcgtaggtaagtaagtaggccccggcggctcacgcctaactgacacagcctccccctcccctcgttgaatccttctctcccaaccgaaaatccctcccgtactaagtagatatatgatggcattaatatccctcgttaatcgtggttctttctcgctcgttccttctcagggctatggcgggggtgatagtgatgatagacgtctagttattggtgaaccgctgcttttctttactagctagtggtagtgactccatacgatctaccatgataaatccaggactggagaatagatagatagtagtaggaggagattggatcaccaatccaaggaatttcgaaattggttggatatactaagccgggatgacttctgtatgtccacagatgttcgttttaccccggctttggctgacatgcctcccctactacttctcccagctagtttagctagctgagttagttacctactttacctacctacctacctaacatcgtacttaaatcacactcgcgcatacttaattagcttcgtatcctctctatatctatcgtctatctgaacacccttccctcctcctttcgctccctcccacttccaccccagacttgcactgcgtgtcccttacccgagcctatccgtcatcccatctccaatctcaaacccccctcatccgataataaccccgataatttccaatcccatgccccgtttatccatcctccaggtacctgcaattcaccacaccgtcctggggcgtccgtctcattttggcttccgtctcgaattggcggtcccttagcgatcccccgatccactcttccgtcccctcattaacctccttccaccccctctttcatcaattttgactttcacttgttctacctaaatcttaaaatctccctactcttctcgtcttgaatctcggattgttacatgacttgttccccactactgattatttccctgcattggcgtcatttggaggattatatcttggtcgttcatttcccaaagtttacgcactatctggagggaaagcaagtgaaagagccgcaagttaaaagacgttgacagcagcagcagcagcagcagcagacacagtggactaagaaagacgacgcagttcaagttgagttgagtgtgtgtgtgcaaccaggacgataaagtcaacgtcactccactgccacggctaaggttgggacctacttttagtagttaccagcaacccaaaaccaaaccaaccccagcaaagtgaaacggggtacctgcttctcatcatccccgccagcgtggattcacactttcttcagtactaccagtaagttgctctcttgtctgtcgctccatgggaagtatgaaccaggattggatcattatcacaataccacatacaccctgccaacacatacatcctactactgtattatgatgctctctccggttttctgtcgatttgctgttcttattttcttccctgcgagattgatctgtagacacccatgactaccaatgtggtttggtggtgggtgttcgggtcatctcaatttccccctgttcctcctcgatcctagttcccatgcctatcttgtgtcatacgcttctcttatgcttaactaaaactaccatttgactggatctgcaatttgcatcaactggattttccagtggatctggttgatactcgttctgtattttatttcacattcgtgttttgttcttaccttctatttttgtttctatttctatactcattttttgttttatttttgttttccgccccatacccacactagctcattcttgccgtctctgtctttcaatgttgcctccccaaggagtgttgaagcaggagatgtgtgcgtgtggtgtggtgtgcgtatctttctgctgctcagcccttcttcgggtttggcgaaaggaatgaaagatggagcccgccgatggcctctgcctcatggccggagagatccaccggcggcggtgcttctggcgggctcgtcctgctccttgggatcactagttgcacccacaccccatccgtccttcccaatttctgcctttccctctctccctcttcccccctccctcctccctccccatctggcactgctcgggcctaccagtctgggtcgccccgcctgcagcccggtcgctcttcatgacggaggatgtgttttttcctcgctgagcatgtccttccctccgtctgcctggccgtttggcgttccctgcaacccgcactatgcccggctctggtctagttggactggcctttccgcccattcatcgcaggccatggtatttttccttcccttccctggttttacctgatcaccaggaagggggaggggggaagaggaccgcctcttttcttttccctttatttttcactgaatttctctcttggtttttcttcaaaaaagaaaagaaaaagatagataattattttcttatgttaatggtcttttcatactgtttgcgatgaatttttttttttcactactttctctctctccaagacagtttccctattttctggaagggaaaggtgagagagagagaggaaagggtaaaaaaacgcgatgctttttacaataccatacatgggtaccctgccaatgttctgggaattgggatgattttttggcgttatttttttcatttttttatttttttggcactgctgctcttccccccatacaactatttcataatttccattgggatgggattgcattccttttttttttttgctcttattttatttttcccaattttttattttattttattttttgttcccttttcattttattcattttttttttttctcttcacttttttattttattttatttttttctcttcccttttttttcttgttccctaaattattatattcctgattttcccttttctgatttatttctatctgcctctttccccgtctcgttccacggatgtttaaggtcaactattgtcccctcttgtcttccgagtccaccacactccttcccttcaagcaactcccccattcacttttgaaacattcctggtctctacttgcctttggaaattcatcgcacttcgtttctcgcatggcccgggtggctttacgtgaagctccaaagtggataaatcggcttacatacctgctccgaaacaggcaccgaacagctcatacggcgtaagctgagctggtctctctctctctctttccctcactatcgcttctcgcgcagtggattgttgcccatccaacaagtcccgaatcccgcatcgtcttgcgcagcagcatcagcaacagccttttgggttgaagagaaactcccgggcccagggtatttaaactccctgtcaaaacgggtttctccttgcgagcagaaagcttgggaattcccgcagctggtttggttggagacacaacctacctcgatccgatcgctatccgtggaaccggagctccagtcgacccagctgcactagggccagacgctgctctccagatccaaccctttccctgtgcgaggatttgggaaaaaggacgggcccgtgctcgctgtcgatccggctcgcccaagtctggtagtagcccttaaactcagaaggaggggggcgctttaaactcgcgccatcggccctcttctacggttcaaccatcaccgtcagctctctcgacttgtcattctctcaccttcgcaccagaggttcccactcctcgtctctcctaaaggttatttgcctccccctccctgcttttctggagtttccccccaattcactcccttcatccccctccctccctccccccccctcccattcattttttagctcgggacatcgtcctggcttttgctgcaacggccgaacaacaaagaaagaaattctgacagcctgtcaggcgggattgttctgatcctattcactgctattcttcctctgcttggtatcgaaaccccagtgtcaccctggccaatccgtctagccgagttactgggaaaccttgatcaacggtggtgttaaccttgattgattttacctctttgcccccctttcaactaggttcgaacctacaaacaaacgcaaaacaatggtcaacggcaccgctacggtgttggagcccaccttcacgggatatgtcgcgacaacacaggatgcgctgattctcttcgaggcctgtctgacgggagtgctgcaccatgtgccccgtcggcctcacgatcgcgaacgtggtcacctggtccgcagtggcagtgtgttcatctacgaggagaattcgtcgggaattaagcgatggacggatggagtgacctggagtcccagtcgaatcctgggcaactttctcgtctaccgcgaactggagaagccgtttccccccggcgaaaagaagcgagcgatgaagaaggccaatcgacgcccggtgccttccacaagacctggggagccgtatccgcgacaggacagcaacggcggttattcgccgtcctcgacacccggtcagtatgctggagaccgaccacaccagtcggacgtggagagagcgttggtaggctcgctggtggactcgtatggcttcaaagattcgggactcgtgaagaagacgatgagtgtgacggtttcgggggtgacacaccacttggtctcgtattacagcgtggaggacgtgatgcgtgggctgctgaacccgccatcgatggtcgactcgctgcgatacatacggcctcgtgcagagctgacgcagaagcaaagcttccgggcccccatcgatgacttggaatcaggatctttagagaacccgaacgacccccatgcgatatacggataccgacctcagttggtagcgccgcccgggtatgcgattcccaaccctcatcctgaattttacatgcaccccgcgccgtacgctgccacccatgctccgcagactgcggcaatcccgggatactcgatggcagggtcaatttcggcgcagtcggcttctaatccctatcttcccgcgccgtctgcacctacccaaatcccgcagaagccagacgactattcccaattccggacacccactcagtatggaacgagctttgatgctctgggtcacagtgctctgtcgtcgtcgattccttctacactcaacacgggcattccgagttccttgagcgatcgcaaccgatcccagtcggatcacagcccttccgcctatcgcaactcgtcaatatcctcacgcagcgttgcgaccgacgccacctcgcccatcgacccagcaacgccggccacatattcacggggaggaagcttcagcctgggcccgcttgatggaccgcatcaaccacttgaacagcgtggcatggctgcgtttgacccaggcatcccgcgccgggagtcgaacccgatgcatgcgccttattatccaggcgcagaccggcatccgtactacgtgagcgctaccgctccggcagctcatgccaattaccccgtgtcgacatgggcagcggcagctgctccagcgcagcctcagatatgactctaaattcttcagcgaccatgatttgtggttttaccctcgctttatctttatttctcatacccccctctttattttcttccgtacgaatttttatttttctattgttttccagaagggcggcaatttgggaatagactatgcatatacgctgtggatgaatacccgggtgggaaaacgctcttagaggagacatgggtggctttttccttgttgctgctgcttctgttacccctacgatgatacgatgtcgatcaaaataccttcttttttctttatatctttattagcctgttcgtgggtagtaccctggggggttttctgggatttattccgtgtttttgctgtttggagggttcctgatttgcgcgagtgtggattggttttctgttcttttttcatgcgattatgagcaatgggacggttttgggtggcatggttctggggcggctatctgtcaactcttttgttctgttttgttgtcttgctacgtgctactacttgatgctcattgcttttgtgtgcttggttcgctatcatcatatccttagttgttacatatgggagaaaccatgggtctttagtggtgtacatggaaacttttttgacgagaagatcccgccagtgatgcatgcatacaaccaatcagtctatcaatcctggggtttctttaaaaagctcatcttccccaatgtgcgctgctttcgctttacgcaactattagtgggcgggtattgtggttcgttttgatgctacggaagggcttttttgaggtcatgtgcggaaaggacaagctgatgatatcatcaattaacatgtcatcacatcattgtcgggggtctagacatcccgattattcaaaggattaattattcaatcttctattaaatattatgagaatgcagtggttgttactactacaactacttctagctaataactttcctcttgtgttatgttatataccgatacctcataaggtcaagacatactatcaagagtcaacattcacgatgtagtagacatatagttcacatacacataacattgaattcaccagccaatcaatcaatcaaatccccaatggtctagaccatctagtagtaccttagctagtatgaaagtatagtactacgtattatcaaaaaacagggaaactgggtagtagtcaagaaagaggtccacataatcatttcagatagtgaaatcagcgggattagttgatcgatgcgatcgatcgaaccgggaagtcaagagggtgttatcctggtagaattgggtggatgtggataatagatgaagaagttaaatgtcacggtgacacttgcctccacaacacaccctccacagcttaactagtatcttaccggagggagggaggagtttgatctagaccgtttcttgattcttctatctctttctctttctctctttctctttcaggggattgtttgttatggtatgaggttgttgatgtatgggatctctgataatcatgagaaggtggtttggttggttggttgatatgggtaatgaagtatggggagttttgtttatttgtgtgatatattcgattcgattgattaaatcctttactcctattagttactttctcatttgatatcattctaatatctaaagaacttcgcttcgattcattgattccattgcggaatattagtagtttggaatgaatagtctagtacacatccagcattacacatgatgtgtacctagctatatgttggttggttggcaggttgtttgagttagataaccgtctgcagaacatgtgctactttaagattttatatatacttggattctttgtttacttcctatttcctagtaatataattcagatagagtctatcctcattttatttgcgtggtggtaagcgttgttgctcgatagttttgggatggtggtgagtggatgttacgtcactactttcttagtaagaaccttacgtgacgatactgtattatacgatactgtaagaggattaccgatgttgctgttgtttttgtttcctcttttgtatttcacactgggtacttgttaaggactaggtgaagaagtatgaatgatactggcttcgtagcttgggtttacttgtttacgtttattagtagtgatggtggtggtggtgatgttgtgtgtatatagttctcacttacctattacttcgtagtttgtacagacattgtagagtagaatatggcgatttactacacttgatgtcatggatcttggtagtaactaccagtagtagtagcatctttttcacgggtagaatatcatactacttcattgtagtagtactatgtaaatgataacgataataaaatggtccacactctgctttggaggtacagcatcgaccttttcggtttatatctgaactgatcgctgcgcaatagttcacccaattctagcgattcaatctagtatgccgggtatatcatgctaatcgctaacaaaccaagacaatcagacacccgccaactcccatgctaaaaatgctatttattatttcccttgcttcgtcgctccgttcgctgcccatttcgtacgttggtcacttccgatgtcacatgcgcgtaccggctgcttgacccatgtgcattatccaacagtaaccgcattgtgaaactccccgggtcgaatcccggtattgcaggaatgggctggttgaggttgagtcccgatttgcccggcagcaaggcggggatcttaggaacttcacgcaacggttcgatcatcgtccaatcgcgggtcacgtcgcgtcggacttcgttgtcgtcttgggatattccgccgtctggggagatctgcaaactccaatgtcagtatatattcctgctctcctcccaaattccaacactcgagggaactggggtaccacgtacgccagatgagaacttccgccccggcatatgcacgtaatcatcaaatgagctttctagggccgcaaagttgaaccccttgtctgccgtgaggggctcgaaacgctggcccacttctgtccggaaatccaccggccgtcgacgcacgggcttgtatcgcggtagggctagcaggggccccgggtaacttgcccaccagcattggacgacggggtcgatgtccagcgcaaactggacccggctctccgcgcggggctttgagatcagcatggcgaaggtaaactcgcgcggcaggcccgatcgctgcagattgttctcctccagggtccacacgatctcgccgccctcaacgtcgaaggctcgaccacgcgggcttttgagcgatcgcaccgacccttgaatccgcatcatctcataccgcttataacgaccattcatgccaccactgggtgagaggctcgcgacgagagggaggtcagagactccaagcgagccgctgaggctgtagttccactgtagtgtttcaggggagacggcgccgtagaggaggtgcggggcatgcatgaggaagcggggatggcgggtccggttactcgacgatgactgctcccttgcgctctgaacagaggcccgaattgtagctgctttgaagcgatgggagagtgtattgggcgagtggaagacgaaggtgataccgaggaagtccacgtggttgtggtcttggttggacacggcggggctggcgtagaacccgtgctgaaggcgctgcacgtgtgcagtaatgtacgcgtctcctggaaggtgtcgctcgtagatacaagctccattcacgagaagacgggggttgacaaggttggggtctggggtggccgtcgggtcagagggctgcttagcttgggcggctggtttcaggggggacgaagaatccggcgctggagcggcaggacgatcaattgtcaccatggccattgtagggtgtgccatggtgaaggatggcatttctcctccatcgcggtcatcccgaatacccattgcaatattgttgttggatctccatcagaaggcagtgcggagaaggaggtcggggggaaaaagatgctatggtatgtcggggggataagtgcgttttgcgggtgaaatgcccgagtttcgcgaccttatcaaagaggccattataagccagtgttggggaggaacgatgacgacaaacgaatcgacagatggacgaggttatatcaggtgagagaggcggcgcgggtcagctgggagtctgcgatggccgcatggatcgcgggcgccaagaggagcggaatcagtcgacagcgatcattacgaagaccattgtcaggtgaaaagaagaaggtctttcgatgagagactgacctcgacggaggtaatgaggggaggaaaggtgggcatgaaggatggctggaaggaagttgttgagccgggaagaaagatgggaggcggatccagtcacgggaaccttatttgcatcgtccccgtaacttctcaatgcgcttcaatatgcccattgctagacggataatctacctgatctcagactatgcaaggggccgtagggctgatctctactaatctctactaatctctactaaagcagcgctaagccagaaatccagctcatatagtcgtcgcgccgctatcagctgctacgacgatcaggagatccggttgatgctatccaccgcgagatcaagttgttagtctgatcttgcgatctgataacgatcgagtgtctgcttggaaacctgttgtttcgagtcaccgcgtggagtatcattgctggatagagtgagatatcgccatgagacccagctacagtccctgactagagtgatatcgtgatctgtaactagcaaggttcgttcacgggtaaaactactaagcagatatcaatcaacttggaagactttaagtgtattggaactatttgactctagactcagctgcattccttataggcggctccaagccggctgtgaccagaacaagtattatacaggcagcattcggaaatccgtatcaggctctttgtctaccagttactgccgttaatgaaaagaatgctgtcatttgtcttcatcaatgagacatttttgccgtgagatacctgtacagaccgctgcttacggatccaccttccctgaagatattatgtctaccagaaagacccatctgccaagcaacagtctgcaaaatctacaccgttgccccgtgtctagtctaagccgctagggcccagtccagccactatgcagatctccaatacgccctagtacgaagctggaagcggagcagagcaccctaggttcatagttgattgatgcttgtttgcgagcagtgtgtagctggacaaacctcgtgtcgatccaccccaaaagacaagctagcaacgagctagtagcatttggttaggaggaaggattcgtgattgacagcactcgatgcagcttcgttggtctgtgaggagctggccccatcacatccaaccttatgcatccaaagacataccctggactgattattgtctcgaactgaattggccactgaatctggtggcaacgacgcggaattgcttgttccctaatatagtagcttcatcctgcatggagtcccatacgagagcgatgattcagtctcatagacacaaccataaccatagtggtttggttgggggaaccggcaacggatgccggaagagtaacgccattgtggggtatttccctgcaggttatgcatatagccgtgctatccgctgttgaaagaaagcagggattgttaatcaatgcgacattagtggagaataacatcgacaggccgacagtcttgcttcggaaggagacccggttacacgaccagcctatacccttcgtcgaacacgtggatctggtaatttcatggcttggacaacattcaccatacgtgcagagggcatgctattccgtcagatgacgcgaatagatgggatacgtcaacccgaaatacggcaagccataacatcgacacgagggttgtaacgccaggtgaattgttccaaagaaaccggattgtgtcaccggtggccgcagaggtagatccacgccaagaatatgaaaggcaacggaaaaccattggcaagtggctcgcagccggacaggctggatcatagaagatagtagtggctggggtgagctatagcggtgcgagagaccgcggaccctggcctagagtggccgggcatgcttggggctagtgccaactaggcactcacaccgagcaacgtgcaggttgacatcgcaattttgcgtccaggtgcagggaaccactgagcatgaagaacgccacagtagatagatattcatgaaaatcgaggagtaaaaagggagcgagggaagaattacgagccactccgcgctttgcgtagctgcctgagctgaccgcaaaatgcgcatggatccgtccggagctgccactgctatactcactgcttagttggagagcacatgcacagatctggaatttgcgctaatttatctggtggactctgcattcaaaccccgcattttggagtttgtccggtgtagacgatgcagtgcattgccgtgtgatgctcagtttcccgaacgcatgcctgaaagtagcattttcacccctaggaagaagcctgggatagagtgtaggaggttgaaatatcagtccaaattatcagtcgagggaggactcctggaaagtcaaaagaagaaaataagaaagaaagaagaagaggaagatgtagtatttcttagttcactcgaagctcaggaagagccagatgggaagcttgagcttgggagtggaggtgaaccgtgcagggaaggcctagaccaatacatgactgttagtggataattgtgaagataccattattggtcagataaggtgaggtcgttgcctggaggcatagtcctgagccgtcagctggtggcccaaatagtagttgggctgttgcttgggaggagaagatgtgggaggtggagggggaggggggaattgaggcccaagcggtgtgatggaaaatggagcaaacagggaaaaaggggaattcaaagcacaaggcgaaacgaaggcctcggaatcccagttggaaactacacgagaagggcgagaaccggcacccatcagatctgacagatcgcacccggtcggcatggaagtcccgggtgaatcaggtgtggctcgggtccaagctctgcccaagaaggttgtttcatggaaagatgagaaccaaccagaggccacggccggaaaagcacgcagaaaggggagaaaaaaagaggaaaaagaaaaaaaagtgagcgatcgtgcaacttttgagctgggaattgtggctgcagcaacagagcagcaacaagcagcaggcttaccttactccatagttggttccgagccagcaccaaacccacctggactgaatcgttgactgactgggtttggccagaaagacatcggcaggctgactcgggtgccggggaccctcttccgattgccgattgagctcagaaccgagtaatctctaggatgaatggatggatgaatgaatgaatatgagggatcgtcatcctcgatgattgattaataatgacaacaataattaactatagcaataatattctagttagtactaccaagaaaagtgactagttcccacgttagtagaaattactggaaacctccctgcgtccccagttcagaagtacacatcaggcatccagatactatctacatatctattacttaactacttatggttagtttaaattagttaaatgagctcatgtcaacccaagcatatgaaacagttagtgagggatgagctagttagttaactactcttaactagctgacagtgattaataatatagagtcagcttccatcaagccaagaataaaggatgagtgatgatgatgatggatgatgacgatgcaagtccaagggaaaaaaaaagatagtaaataaagtaaaggtagccaaagagagcaaataatcgagtcgaggtgtttcggactaaccgaaaagggaccccgcttcgaattttcagattgttaacgccggtctggaagtcagtggaagtaagaaaagtaggcttatctccgacccaccgttagggatgatgacaagcagggaaaacaaacaatccaaacagcaaagtcaaaacgaggaaagtgcgcacaggaagatgatttcctcgaattcctcgctgaatccgcgtcgctccttccgctttcagagcccttcggtcccagccgacccctgaatccatggcgtccatgaccaatcatatttctagaaagtgacatccgtggacctcatcttgactcatgaaaagaaaaagacccacatccgcagttcacccgatggaatgtccagcttccatcgccttcttgctgcagttccaattgtcagcaatccacttcttcgatccgtctctctgcgctctctgattgcttggttaattccgtctgctcgccgtcgccgccacggatatggaccctggtccgtttcgggtccatttgctgtggacacaagccgactctattgtcgctgctcctttgcaatcctgacaaatccgcctccatcttgccttgtgtttctccagtttcctcatgaattattttttttcaggtggtcccgcggcgttagcgtctgataacgccggcgccgcccatatcgtttatgcccgtgatgcaacgtccgtctagactggcttagtatttattatctttcttcccctcccccatgtctcagtggatggctcttgtttcttcctcgccttgagtcgattacggtctttctttctttctcctccatccctccccttccccaatctccactcctctcaaggcgtgtgctggagctcctggagcgccccagttccgtgccacatcctcaactactccccctaactgcgctaatcatcgcctttatcttttggctgtacatatcttccatacatacccaaacttggattttatcccttgccttcccgtattcgttcttatctattaatatctatttattatcctgatctttcccctcccacttgacttcggttggagtttcataccgtcaacaatatccctggattcgccgtttcgctttgcgccacccccgtgggtaacctacaatatcaccaccaccttacgttcgacttgcagatctccacctcggaattcgcctgacgacaggcgccaccccttccaccatggctgacgaagctcgtcagccggatgcattgcaaaatgtcccgactatcacccaggagcactcccacgttcaagaaagctcccacgttctcgcctccgaccagaccgtgacctctcaatcgaccagcgtgaccgacctgtctgctgatggccgttggggagaacaggaagaggagcccgtctcccgtcgcggcgccatggaggatttcgaggaaatgcgcaaggaattgacccgcctcagtctgcaccagacccgttccgctacccgagaagcccagcgtttgcgctcgcgcgccagccaggctcgcgatgaggagaaggctatggatgacgatgacgacgacttgtccggtaccacggacagcggttatggtggtttcgacctcagcgagttcttgatgggcggccatctcgaacgccggacgaccgcaggcgaacccgccaagaaggtgggtgtggtgttcaaaggtgtcaccgtcaagggtgtcgagactggtgcttcttttgttcgtacccttccggacgccgtcatcggtacctttggacccgatctctacaacattatctgcaggttcgccccccaactccgctttggccgcaagcctcccgtgcgagacttgcttcacgacttcactggtgccgtgcgggagggtgagatgatgctggtgctgggaagacctggtgcaggttgctcaaccttcctgaagaccatcgccaacgacagagaagccttcgccggcgtcgagggtgagatcagctacggcggtatgtccgcggaggagcagcacaagcacttccgtggtgaggtcaactacaaccaggaagatgaccagcacttccccaaccttactgtttggcagacgctcaagttctccctcatcaacaagaccaagaagcacgacaaggcgagtatccccatcatcatcgatgctctgttgaagatgttcggtatttcgcacaccaagaacaccgtggtcggcaatgagtatgtccgcggtgtgtccggtggagagcggaagcgtgtcagtatcgcggaaaccctggccaccaagtcctctgtcgtctgctgggataactccactagaggcctcgacgccagcaccgccctggattacgccaagtccctgcgcatcatgaccgacatcagcaagcggaccacgctcgtcactttgtaccaagccggtgagagcatctacgaactcatggacaaggtaatggtgatcgaccagggacgcatgctctaccaagggcccgccaacgaggcgagacagtacttcgtgaaccttggtttctactgccccgaacagtcgaccacggccgatttcttgacctccctctgcgatccgaacgcccgtcaattccagcccggccgggaagcttcgactccgaagaccccggaagagctcgagtcagtcttcagacaaagcagcgcctaccagcgtatcctggacgatgtttccggctatgagaagcagcttcatgacaccaaccaggagagtacccgtcgctttcagaagtcggtcgccgagtcgaagagtaagaccgtgtccaagaagtcgccgtacaccgtttctctggtccgccaggtcgccgcctgtgtgcgtcgtgagttctggctgctctggggtgacaagacctcgctctacaccaagtactttattatcctgtccaacgctctgattgtttcgtccttgttttatggtgaatcgttgaataccagtggtgccttctctcgtggtggtgctctgttcttctcgattctgttcctgggttggttgcagttgacggaactgatgcccgcggtcagtggtcgtggcattgttgcccgtcacaaggattacgccttctaccgtccgtcggctgtttccatcgctcgtgtggtcgtggacttcccggccatcttctgcatggtcgtccccttcactatcatcgtttactttatggctgggctcgacgtgaccgcttccaagtactggatctacttccttttcgtgtataccacaacgttttgtatcacggccatgtatcgcatgttcgctgcgctttcgccatcgattgacgacgccgtccggttcagtggtattgcgcttaatgtgttgatcctgtttgttggctatgtcattcccaaacagtctcttatcgatggttcgatctggtttggatggctcttctacgtgaacccgttgtcttacagttacgaagccgttctttccaacgagtttgccggccgcctcatggactgcgccccatcgatgctggttcctcaaggttctgacttggatcccagataccagggatgctctctcacgggctctcagctcgggcagacgcaggtttcgggttccaactacatcgagacggcctaccagttcactcgccatcacatgtggcgtaacttcggtgtggtcatcgcctttactgtgctctacatcctggtgaccgtttttgctgccgagttcctctcgttcgtcggtggtggtggcggcgccttggtgttcaagcgctccaagcgtgctaaacagctcacggcacagagcggcaagggaagtgacgaagagaagacccagggtgctggagtccaggcccagtccaacagcaacagcgagacgttcaaccgcatctcatctagcgatcgcgtgttcacctggtccaacgttgaatatacggttccctacggcaatggcacaaggaagcttctgaatggtgtcaatggctatgctaaacccggactcatgatcgccttgatgggtgcttccggagctggtaagactacgctcctgaacactctcgctcagcgtcagaagatgggtgtggtgactggcgatatgcttgttgatggtcatcctctgggcaccgacttccagcgaggcaccggcttctgtgagcagatggatctccatgacaacaccgctacgattcgcgaagctctcgaattctctgcgctgcttcgtcaggacagaaatactccggatgaggaaaagcttgcctatgtcaaccagattatcgaccttctggagcttgaggaaattcaggatgccatcattggctccctcaacgtcgagcagaagaagcgtgtcaccatcggtgtcgagctggctgccaagcccaatcttctcctcttcctcgatgagcccactagcggtctggacagtcaagcggccttttccatcgtgagatttttgaagaagctttctcaagccggacaggctatcgtgtgtaccatccaccagccctcgtccatgttgatccaacagtttgacatgatcttggctctgaaccctggcggtaacaccttctacttcggcccggtcggtcacgagggacgcgatgttatcaagtacttcgccgaccgtggtgttgtctgccccccttcgaagaacgtcgcagagttcattcttgagacggcggctaaggcgaccaagaaggatggcaagagctttgactggaacgaagaatggaggaactcggagcagaaccagaagattctggatgagatcaagacaatcagagaagagcgcagcaagattccgcttgatgagcagggcgtgccgtatgaatttgctgctcctgttaccacccagacctacctcctcatgatgagacttttcagacagtactggagagatccctcctactactatggaaagcttttcgtcagtgtcatcattggtatcttcaacggttttgtaagtaccctcgactttaactctcctcgcgtacactcagctaattctcatgtagaccttctggatgcttggaaacaccatttcgagcatgcaggaccgcatgttctcgatcttcttgatcatccttcttccgcctatcgtcctgaacagtctggttcccaagttttatatcaatcgggcactttgggaagcacgtgagtaccccagtcgtatttacggctgggtcgcattctgcacggcgaacatcatctgtgaaattccgatggctatcatctccggactgatctactggttgctgtggtactacccggctggtttccctacggattcgagtaatgccggatatgtcttcctcatgtccgtgcttttcttcctgttccaagccagctggggtcaatggatctgtgcctttgctccgtccttcaccgtcatttccaacgtgagttattctgcgtgtcaaatcaacagaagcaaacccagctgacatgttcaccagacccttcccttcttcttcgtcatgaccggcttgttcaacggtgttgtccgtccttactccgcgtaccctgtgttctggaagtactggatgtactacgtcaacccggtcacctggtggctccgtggtgtcatctcgagcgtcttccccacagttgacatcgaatgtgcgtcctcggaaaccactcacttcaaccctccccccggccaaacctgctctcagtacgccggcgactgggtttcgagtgctggcgtcggctatctctccaaccccaacgcctcttcggattgccagtactgcccttacgccaacggctcccagtacatgcacaccctcaatgtgcacgatggcgacaagtggcgctgcttcggtatcttcctggcctatgtgatcattaattggttcctggtctacttcatgatctactgcgtgcgcgtgcgcggctggtcctttggacttggatacgtcttcactgtgctgggtatgctgttcggcagcatcaagaagctgtttgtgagatcccccaaggctcagaactaaggctcttgccactgtctctacaaccacagcccattcatctatgctaatagatgctggtgcgtgagttatctcctgatgataatcatgggataaacaaaaacaaaaactaaaataaaacacatatcactaccagacacacatatacagtcaaatatatacaaggcctatgtggcctgagatacgagatgaaacaggaggaagatagagaaaagcatatcggttcgggaattttttaccccctttttctggtttacgttatcatgcagatagatagagatgcatcagcgtgtgtgtttgttgggtggcttggctttttttgtcagccttttcttgtttgtttctttcttgggtttatattttatccccataataggtacataatgcatatcatccgacatatatatatttcattgatatcctcctagtagtaagtagcagcaactttgtatcttcagattggtcagatatttcttacttatctaccaagacaagtatctgtctgtatctttgcacatacatctacccacaaatatcacaaactccctaccccttccaagaaataacatccagactagtagtatcacaaaccactcacaccttcccttaactgtcacttccactccgacagaaaaccaacatcaagactgactctccgcaaaataccaaggcttcctcccccctccatacctcgccccgggaacacgcatcggaactggaatagtattctcgaatacaaccgggagatttgccccgtcgtcattatccgatgatgataacgaagaaaattcagaggctttgcctttgcatttatcttcgtgtatcttatccttcaaatctgagctatccgtcctgtcttcaataacggggactattacgccgcattcccagtttcggcagttgagcttgggggattttgttgagcggtcttgaacgaggcggcccctgtggaagagaggtgagttgggttagtgaactagagtgttgggttttggggaggcagtcattgagtagaacacgcaccaggcactttcggacatattggcacttccgatgtaagcccatgcgcggcattgggttgtttctgataaagggatggggtcgtcggggcggacgtagaggatctatcgttgagtgatgtgaggaccttatcctggagggaaaggaaggggggtgatataagtaccttgttatgcattaacaagccctttctttgactttcacagtcgcggagtatatgccgtgggaagttctcgccgttgtaccattttgactggaagcagacggtgcctgcgcagcggggacccccttttgacgttgcgactgtgttctgggatgggaaatagagacggaatcggtcactccattcggagcctgtgtctttcttgaggagtttggaaggattgtcgcgtcgagggactgggaaggttttggcgtagcggatgctgaattcggtaaggccgtcgtcacctttgggtttgggaggtccaggtgtcagtttccgggtctatgggggtaggggcaggggatatgggagtctgtgtaccttgtgaagcgaggtacatgcagcggagaaattggtccgttatagcgccaacggaggaggccttttaattgtgagcatgtagtagatgtttatgggtagaaagtatgtgctcacgatgtagtcaatattgagtggtatggatgtacaaaggttcagcctttccactgcacgacctaggccgcagtagcctgttcgtttccacgctgtatctgtgtgagagccaccactgggactgttagacataatcaatgcggttagtgttagcgaaaggaaactcacatagtatggacaaaggcatatttcgatgttttgctaaagtcaaaattatcgagcttagcaatgatattctcatgaagagtactggctttaaggaaaaccacaaggtcttcatagaaatgagtcgtaggcttctccaggacattctttttcggaaggtcaataagaaagacgctctacaggtgtgtcagcagggattcaccagaggttgacgctcttgtgcctattacattctccatgactccgttcatctcaccccagtcatatggggttaggttggcagtcggtaccaccaggcgaagatattcagggtggaagagcaacatcaacttcgagtgcatgcaaacgacctgcccacccattggtgggaagcataaccgcaaattccgcatggtcgccgtctctgattcgtactgacgtttcttctctagtggttagcttgttctagacaaagactcgattccagcatgcaagggacgatggaaatactcactgtagcatcatcctcagcctgcataaccagaataaaacgggttttctcaatgttaaatttactgaacagccattccatctcccacatgaatgaactcataacagcaagctctagatcagccttctgcaagacctcttcgatcttgatatcgtccccttgccgaggatatccaaaggcccatgtctttttgacagcaccctctggatattgagtcgacggtgaggtagatgggatggacctagagcttgtaggctgggacttggacataatcgtacccccagcagccatggtgggttggacactagcccttggggctgagtcgatcttcgattgcttagcttcacggtgatcaatagagctagtatcctcagcctttcttttagcaagtcgtgcgagacgctcttgctccatctgctttcgatcgagaccaaggacacccatggacttagcaggttcatggtcgttcgccttcccttcgacctcttttactgagggggatctagtgttctggctcactcctttctcagagtcgctaatatgtaagtgactggaggcgttatgcgggcctccttcagcttcttgcaacgagagcgcaatagctctcttcaggtcttcatcatattcatcgtcatcaccagcttcgtcatccgtgtcggatccaattacggattgcgacttcggaaagacgggtataacttcatctgaatctgactctgctgtgagatccacgacctgtctctcggcgttgcgacgctggtcaggttcagagtcaagatcaaacgtctcaaattggcgtccctcttcatttggcgccatatttagtaatttttcagtgacagcaaatgtgaacagttagaggagaatattaaatgagaggatagaaggatagtgatactaagagagggtgagtcggtaacaagcagcggaaagaaagacaggccttatggtggtttgtaccggaggctgtctgtttacaaggccgatgctgaagatgctccagcgcagctaaacaagcgcaacactaatttcatcaaacaaatgatctcagaattcagtaaggaatatcacatttgagaaacaagaaggttgaatggatttggaggaagttgttaggagtgagggagtgcaggttcacttcacaccctgggatcctggcagtcggcacgtgatcgagacgggctgagctggagagcaccagttgaaccccaatgcaccatataggcagaaggatgccaaatgtctccatctgggactcgaaagggagaaaagatgggcatgtactgatagctgtaagtactgggtctacaactcagcgtgtcaagtatgttgctacaatgtaatcattcactactagcaacttgtgttttgattgcgtttggctaatgagaccatgcaaacagttggccatgcacagctgctccaggtcatggttttcccgactatcacagactatcccccttttctgcccatccttgcaactagccttgacccaagtttgctgcttaatctaaaatcgaaccccatctccaaacattccgcgcatcttcgtctcgatgacatggctggagtggctccatcaggaatctttgaaagccaaggcctgcatcagagtctggtgcaagagcataaccgccatgatcccagcaatcgtgggtaagtcgtgttcagcgtgttgatcaaccccgaactcaatttgctgctaacatcggacgccgtcaagaccagtaattcgttttgtcaagccattgtacgacaaagaaacagggcttattagtgatttcgaagaacatgacaagcagccgaagtaccgtgacgtagtcgatgaagggatcacaaaaatgctgaaagtagcccagtttgacacgcagccgatgtcgaagtgtctcctgtaccgtctccccctggaagtcagactgaaaatatgggaatgcctattcccgcactactggagcaccgtggagctagagaaattcgcacagacaaccacgggcctcgctatcctcctgacttcacatcagatcttccatgaagccttgctggtctttttctattcgcttccatccagcaggcttatcctcaaggagtacggagggtccactgtgcattacctcaaaagtgtcccccttaagctggatcgatgcatttataagcgccgaggattcatttgtctcgatattgagtgcgacaaagaaagaacgtttggttcgcttgtgctctcacttggtgacaagaaccatgaagcggcagttcgatgtcgctgggggttttcgctcttcattaccaccttgagaatggagggaccattgcgtgtccatgatttgaccgtcgctgtcactgaaaattggaaaatccccaggtttgacgagaacgatttgatccaggctttgttcagtggagctttcgaggtccttgggagactgatattcgtgggcttcactaggatggaacgaaaacgtctcaccaacctaatactcgcgaggcaggacccgtgcgtgcaactcatgcgacgtgggagtgatgttgaggatatagttcggtaagtggaagttcctagcatagtgttggtcatgtcattgggccatcttattggctcgttagatgcattgcagcacgaggtcaatgacggcaaagaagacatctctatccgcgtcggcagtttcaagcccaaggcccaaaacgagcatacgtttctcattgggcgtcttggtgacaatggcactggcgatttgacgagcataaagctgaccaactacctcatgtccaggagcccggccaccgagcagtgacgtggcagtcaaattgccaataggaagaagactgtcctcagcaggctcagaaatggtgtgaaagccctctgttcctgggtttttgttctcaagtggcacgtgaagctgaagtaggttagttgagatgagaagagtatggcatgactattgactaacccaatgtcctagtcggccgttctgtgagattgtgattaaaattctgtcactaaatttgatcaaggtgacatttgtctggatacccttgacatctccaacaacctgcttcgtgactgcggggtagggcaggtttagatcctggagttggttgatgtcaaaaggcgcactatccatggttgttttttgttgttattaatgttgagagatactctgacaagcaataaaatgcacaagttctcttcttaggatgatgaaaaaagaataagaataaacagtaacactataataaacacgagggaaacgcgacgaggcaggagagggagaggagagagtgaagaggggtgactggccgtgaagtacaccccaggcggtgaggctatactcaccgctttccgggcagaatgtggccgccgcctgatttttttcacggcactctcttatcgcggttcacttttgctttcattctgggacctgattcactttgtcttgcagttaaggcaaagggtcaattctagtgatcatgcccaagtttgtcccccgccagcgaaagcaaaagcacaagcaaagggaggcaacaaccgccccggtagacaccaatgttgccgaacttgcgcccgtctccaaagatgagaaggaggctaagcggcagaagctaaaagaagaattgcgagcacagcatgctcaggtttcttccaagaagcagaagcgcttggacaagtatattgtgcgtgcgactctacattaactatcctccaatgttgtatctaacgctctgtgcaggaaaacaagctaaagaaagaagagaatcttgagctgctaaaaaagctcgcggaatccaaggttgatacctcgtctctccagagctctagggaattaggaaagcgcaagcggcaagatgaagtaccagccgtatctagaaccgcggaacccgactcccgccttgatcaggaccttgacctctcggacgatgattcggacgattcgttgccccaattgaagaccactgttagcgcatctaaatctgaagcccccgcgcaaaaacccgcagagaatccagcgatcggtatcgggttaaagcgccctctggaactcggtccagatggattcccggttctcaagaagcgaaagcaggtttcgaagaaacccgagataacgatcacgatgccagaagtaccgtgggaaggctttggctcggatgaggatcaagatgaagacgagaagtctgaggagggcgaagatgaagattcggagggaacatcctccgatggctcaagcgatgagggaagcgagagtgatggcgaggaagaagaggacgatgaagacgatgatgaagagagcgaagaagacgaagacgaggaagacaaagaggaagagaagcataaagtgggccaacctcgacaatctgccttcaaatcttgggccaggcaacagatcaatgatgccatcggtttcaagcctaccactgttccagtcgtcgaggagcagcccttcatcccggaacgcaagaagccagtcaggaataccgttgccgaggaagaacccttacccttggaacttcaggtcaccacaggtgatcctaaccggaaagcctttagtgttcaggttaaccggtcagaggaaatacaaaatgcacgcttgggtctgccggttgttggcgaggaacagaagatcatggaagcaatctacaataattcctcgatcgttatatggggagctaccggttccggaaagacaacccagcttccccagttcctcttcgaagcgggctatggtaacccggacagccccaatccaggcatgatcggagtgactcaaccgcgccgagtcgcagcagtcagtatggcgaagcgtgtaggcgaagaactgggcgaattctccgaccaagtctcctatcaaattcgatttgagagcacagcatctagcaaaaccgcgatcaagttcatgactgatggtattctcattcgcgagattgccgaagacttctccctcagcaagtattcagtcatcgtgattgatgaagcccacgaacggagcgtcaacaccgatattctcattggaatggtcagccgcattgtcgacttgcgcaaggctatgcaggaggaagacccgtctgtcaagcctctgaagctcgtggtcatgtctgccactctgcgcatctccgatttcacgcaaaacccgaaccttttccgccaaggaccgccacccttggttcaggcgcaaggtcgccagtaccctgtcaccatacacttctcccgacgtacccatcgcgattatgtcgaagaggcattccgcaaggtgtcgaggggtcaccgcaagctacctccgggtggaatgcttgtgttcatgaccggacagaatgagatccgtcagctgtccaagcgtttgaagcaggccttcaaacccacccagcgtggcgaagctactcaagccaaggtccaaatctctgccaacgatgcaccccttgaggcagaggatctcgagatcggcggtgccgacctgtcacttgctggcaaccaggaagatgacgagagcgatttcgaaatcactgggttggatgaacccgaggaagacgaagacgagtttgatctgggtgaagaggccatgagctcgacgactcgggtccacgtgctcccattgtactcccagcttcctaccaaggagcaacttagggttttcgaacccccgccggaaggctcccgccttattgtcttagccaccaacgtggctgagacaagtcttacaatcccgggcataaagtacgtgtttgactgtggcagagcaaaggagaagcagtacgatcttgcaacaggcgtccagaaattccagattgaatggatcagcaaggccagtgccaatcagcgagctggacgtgctggtagaactggacccggtcattgctaccgtctatactcttcggcaatctacgagaatgaattcgccgaatacaccgacccagagattctgcggacgccgatcgagggtgtcgtacttcagatgaagagcatgggacttcacaatgttatcaacttcccattcccgacaccacccagccgtcagggtcttgccaaggctgagaaacttctcaagaacctgggcgcactcacctccgaaggccagatcaccccaataggtaaccgcctatctacgtatcctctgtctcccagatttggcaagatgctgtacgttggccaccagcacggctgtatgccgtacgtcatcgcacttgtttccgccctcgcagtaggcgatctgtttgttcccgagaaccagatcgatcctgtaccagccaacaaggacgacaacgagggcaagggtgtatacacgaactcggaccgtctcgaagacaccgcccgggagcagcgccacaaggactacgcccgggtgcaccgtctcttcagcaagcacgatgatacttccgacgcgctgaagtacctgtcggcgatttgcgcctacggatacgcctccgacggagattcgttctgtgaaaagatgttcctgcgcgcaaaggccttcaaggaagccacgcagctccgtcgccagctgacagacatcgtgcgcagcaacaacccgggcctggttcaggcctatcaggcacgcttgcccgaaccgaccgaaaagcaggtcaaggccatcaaacagatcatcacggctgggttcatcgacaatgttgctctccgcgcggaccttgcgcccgtcccgcctgagatgcaccgtacccccaagcgagctatcgatgtcccctacttcacgctgatgcggtctcgtgacggccccggcttggagcttgacgataaggctgtctatgtgcacccgtcgtctgtcattgcgcagctctcggctaaggaaatgccccagtatattgtgtactcgcatctccagcaatcgtcgccctccattgtgtctgcagaccagacccctaagatccggatgtatcccctcgccacacctagcggactacagctctctgcgctggcacacggcacaccgctgatcgagtacggcaagcccatcggcaagacggagttgatcgagggtatccctcagcggcgatcatgctgggtgatcccgtctctggtgggtgaggccggcggatcacggtggccgttaccagccaagaaggtcatccaaaggaaggatgcgaaggagggatgggtgattgaaaaatttgtcgcataatgtatataccagacgcttacaattacaaaagtggtgatgatgattatgatgcaataatcagctgctatcccagtactgtagtcatgataatgataaaatagaaccagcacccatgccaaccactaacacctttagaaaagaacacaaaaaaaaaaaaaaaaacaaaccacccaaatgcaatcaatcaaacccatctcaaccacactcaagaaaataacccatctcccaaattcccacctatttctcctccttaatccccaacgccctcctcaacctctcactctcctcaatcttcgcctccgccaactcatgcacctgataactcttaaactggcgtctctccttcggcggcaaatcccacgccctacgtccgcgtctcccaccaccattcccacctcctccacgttccctctccttatcctcctcctccatctccttcaccaacttcttcctcaacgcctcacacctctcctcaatctcctcctccgtcaacaccctctcaccctcctcttcctcttccccttcttccttcttcacatcatcatcatcatcaccacccttcttttgcttcttcttctgcttcgactcaagttcctcctcaatcctctcattctcctcctccaatctctcccgctcctccatgactttcacttcgattgcgcgccggcgatcgtgctccaggatctgcttgtcgggttgtcgctgcttgaagggcttgtcggaggggtcggcggagttcgagccgctgatgggagggtatggcgcgccgtatccggcgttgcggggtttcatgaatgcgaagttgcgttgcacgtagcccgaggtgccgctgcctcgcggggtggagaggccgacgttggaggacattttttgtttctttctttttctttctcggttctttgtttggtttctgtggggtttgggtgtggtggggtgaggctgttgggtattgagcgagtgagtgttggtttattggggtagaagtggtggttgaggataatggatattattattgctggagaggcgaaggtctggatcggcgagtcatgcggcgatggagagagcttggggtcacgtggtgataggtaagtgataaggcgggagtgagaggagatcgagattgctttaagttgctgttcgcttagatatgcagttcttctacaatacttaaattgcgataatttcaagggtgttggatcagcaacagcaatgcttttcattttgatcgtctgtataccgagacagcaaggcctctacatactctaggcatcccttatattctccctatttccaggtctcccatatgtccatgtccaaggtcccgttttgtaacccatcgaagaaaatcaagcgcgatgtcccatgaacccgttattcaccaataaagacgccggcccctcgtgtgtgtgtggacaaagagaaacagaaaacattgataagctatggaggcgtgtcctcattttcatcacgtcgaacttcagagtaacagaagaaggggaatacatcgacaagcaattaaatgggtagagaggtagaaaaaaaagtatcaagaagtgaaaagagggcttgaggcgaaaattggaagcaatgtaaaaatagcaaaaggacatcagtttccgccgtcaccctcgttgtagcgccataaagccatgaagttgggcaagaagatgacgaagctccgcgcttctaaacctctttcgcgcccacaatatgtatatccccaagtattaagagcaagttgggagaatgtgcgtgaccagttataaagatataattcataagaagtaagaataacgttcggaacgtaacaggcctaggtgcttccagtgacttcgactgagtcgctggtgaccggatcggccgactcacattccgccaagggcgtcaccgtggttttcgccatatgcttggtttccgaagagccatcagcattgctctgcgtatcggtgggaggcggggtcggcggagcggcgccaaccacaggagcacggcagttctcgacaccattcacagcccttttggaaggctggggggaggacttgtgcgagttgggaggcgtcgtggatgtggctgcgtgggccaggggagcgccggagggtggcacgacccccccaatcaacttttcaatggccacgatctgcttgccataactgaacttcttcaattgatcaagcatcggctggatgcgtacggccagactgtacttctcttcggacgtgtcgtccagctgcccaaggatcttctctgcaagggaagttagtaagcataccaaattggcggtttggaatgcaacttacggatcacatagttgccgtactgatcacgcatcaggctgatcagagagctgtcccctcgctcgttgacgctcgtcagcgtgctgatcatctgccggcgttgagactcctcgccatattcgatgctcttctcgaccacattactagcgaacttgtgcttggagtaagtcaagagttgcgacatgacgaccacaatcatacgagaccgatctttgtcttcgccgttctcaatgacatgctgaatgacatagttgccaaactgatctgtgatcaatttggacgtgcaggcatgcagttcacccaagatagactcccggtcaacttcctcacaatgctccagcatgcgctggatgacacggcacccgtatgggtgtgtagccagtcgctcaacttggcccttgaaagcattgatgataaattggacgtattgcgatgggactctctcgatggccttctgaatgacatgatttccattctggtcccgaacacagcgaagaacatggttctcgagttctttaaccattgatgcttgctgatcggtgaggatgtgttccaaagcctgtcgcgaattagattttttttgtattgagagacgagcagaagacacttaccttttgcaccacgcggcacccgtacatttgggtagacagggatagaatgtgtcccttcatttggtttgccaaaatctttttctgagtctgatttccgtgttcaaagagcttctgaacaacgtagttgccgaacacatccgtcatcaactgcaagctgttggactgaatctcgcggaacacctgttccttctcatcgctgttggcggtctctagtttctgttggatgaagcgcgacccgtgctggtcgccactgaattctacgatgtgaccatagatatcctatcacggaattagcaaaataatttaacgagacccgactgttacttacctttagctcgtagcgcttgttccccttgttttgagccctaaactcctctaacactggactccgcaccacttgtgaaggatcatggtcacgatgaccccgggagacaagagccgctgcgccaatctgggcgacagggtggtaaaaagagagggcattgagcctctgtgcttgataaccggcaagatcataagcagcaggcatttggaccctgtggagtggattgaccgcttgctgtgaaagctcctggtcagctcgtagcttctgctccagcagtgcagccacattgcccgttacctggcctgcggaaccggtacgaaagtgtgcgccattatcctgagcgtaaaaggggctgtcaatgcgatattcagtgggagatatgggatttgtgtcctggacccgcgatctgctcggctgatatcccaagggtagctctggtggaacaccttcattaccgtaaccgggcggaagttggtattcgccctcgtcattaccgttgtgatatttcaatcgcgtcagactggcatcatacgatttgtgtggtaagtaggctggacggttaagggccgggtgccccgagaaattgccctcattcagctgcagcttgttgagaccagagccaagatcgacggagccactaccggaccgcccctcgtagccttggctttcggagtggaatgacgggtaggtggagtgcgatggtcgctgtggcgcgaaggaagccgagttatgcgcagtgtgggaatatgagttccgtccaatgtgctgcgtcatgtaatcaggtagagcagactgcagggtggacatgcccaacgatgtggtcacgtcatcagatctttgattgtctaatgggcttgtaaaccctgccttgacgggaaacccagatcccacagggcttccgccaaaggcagaagtgtttacctgccgcctgttatcaccgtttctcattccgaaattgccaaggctcatgccctcgccagacggtgagatgccgtcagacccggtgctcaggtaagctttatgtccagcaccgccacttgaaccaatccccgatttgggcaaggcaaaatatgaggaagagtcggtaccatcaggaagaccagctgcgctgcgctcattggcccgtgtttgtacgggagatgtagtcatgccgttattcggggctcgcgacaaggttgccgccgatgtgttgatcgtagtccatgggaggttaggacgggtattccagccatcagattcggaagacgacagtaaagaacttgacccagctttgccctcgaaagcattctccacgctgtgctggtctgtaaggtccatgtcagcggcaatcacccgagtagacaactgtcccactagctgcgtaccatcgaaaccgcttccccagatactgccattccagtttccatttccaccaccgaagcctgtccccatgctcgagggagctcctcgcgtcctctcaccattaaaccccgatgaagtcatattccccgcccggcctgaacgaacctgtatagcagtcaacgagccagtccgcttgccacttgtccgaacgaaacctacattatgagctgtattctggttggaagccatactgaatcctcctccgtagatatgaaccactccgtagatgttcgacgtatgaatagtcgatcgtagccgactgtaaggctagtatatgacgtcgttgtgtgcactatcgtcttgatacactagatgacaatgaggctgaagtaatacggataattatacgacccgtgatgggggggaatcgaggcacgaggtgactggtgaataccgaactgcacgagtcagccatccgatcagattggagatcaaagcacctgaagccagttgcgaacggttggatgaggtgtggacttacaaaggagtgaagaagccaacaccaaaggaaagggatggaagtgagatagggcggcagcgaagacgttgccgaagaataggatttggactgggtccagaatagacgcggtcaggcgctgtacaaattatacagggatcgaaggggggggcacgaaagggagaagtagcgtggcaggcgagaaatgctaggcggaggaaggagagagggaggccgtcaacaacgcaaggtgacaagagcttgataaaaagcgcttcgctttgtccacccacggcccagcaaatagccgtagatcgaaatcgccagaaggtattgcgacgttactatgctccgtgcatgctccaggaagttcgaatcttgcagatcgccctcatgtgccctctgggagaagggagggatagccgacacgggggggggtatccgtttaatcagacagagacgttaggagctcggacgattcgcagcggcaagggggaaggacaaagggttagagagagggtgcagttggtatgggcggagaatgtgcttgttgcgcaaaaaaaagacgtgattagtggaaggtcgaaggatgggaatgtggacgagagacaaggcccagcattaatgtaattcagccgtgacacagacaagcgcaagcatgacacccgaagtggttccgagcagatcagtcaggcctttttatccttttgtcgcaggttcggttcggcctccaccactgggcgctggatggcgaaagtttggaagggtggagggagggagggaagaacgacaataaatgaccgaagagcagagataaaatgatgacagagcgagagggaagaaaacgatcaaatgatgaaatgaggaggttagaaaagaaaaaatataaaaaagaaaaatataaaagaggagaaagtttaataaaggtttgttgagagtgacggtcgaaatcaagcagggaaagggaagaaaaaaggttatttaatcaaattaaggaaaaaagggaaaagaaaaaaagggtctggtttggtcaatgtgagagaaaagaccaaagttggtagcacaaaaagaagcaccccaaaaggccccccagatttgcgagaagaatgacaagggagggagatgaggagaggggtgggaaaaaaataaaaaagaggatatgatgagggaaagaagaaaatccagatgaagaaaacagggagggaaacctgcgggcttcaaggacagaagaaaggaaaaagaagaaatcaccaacggacctctcttttctggcagggcgcaggatcgattcgaaggtgaggattggagatgatagataagctgggcaggtcaagctggaaaaaagatgctgcgtgtcttgcggcaaaagaccgattctgttggcgcccatcggtaactttaccggcggtgacaataccagacgatctgtcgatctgctcaggtacttggcgggcgtacgtccatcgccgctgctgggcaggtaccgggcgtatcgctctgcccaccaggccccgtctgatacgcaactggatctggggccacccaaattcgttcccgccgcttcttttttaggcttcaatctaggcggcccctccctctcctcttagggctgttttcttcctctctgatcgcgtctgggtttattcccccatcctgccaatgatggtcgctgccatcactgtgagctactagatataaccttacgctacaaatatacttcaatccactgatatgcgaccgtccctgactctctggaatctccccccgatcctcctctttttctctctctctctctctctctctctctctctctcccgttcttttggaaaatcatggtttcacgaaccacatcggagacatccacccaacagcaggcatctctggttgaccgctacaaaactaaccctctcgcctttctgacatgctaatctacccctcgctgttgcgtaatagattattcttcattatatcggtctttaattgttggttaatcacgtatactcccatcggcgagatgatggagccatggtctggaatatctttggaacgtccgagaagctgtcattgtctgtctattacttacttactactagtagtaagtatttgctcccacctcagcctcatcggacatgacttcctggccaactctccgtcacatggcttggctcatctgttggccactgaccaccactggcttccagactcttctgatgctgacgattatcgaagcggggtagcatatctggggagaattcaagaggttccgaattctcatttgaccgtcccttggataatcacgggccacggctcccattgaagatttgcggtaaaggttaagttgcgctccagcccgaccgatcggatccactaaactagcttgttttctggtgatgaatcagagtttattctcgccaacagtaacattggtttggtgaggtcttttgattaattacctacgctatcattcattaatttatccctatgtaggggcgggatggtaaactgtatgataaatgcgatcatcactaggcgtagttgaaataggagtcttactactatgagccactgtccactgcaactgtagtagtgcttatcatcatcctaggttcccatactactaataccataatatgttcattatacatgcaagccccccagacttccaatcaactcgtttgcatgaccatgacaacattagccctgcagcgaccatacgccctaataccaacagataactacctctaccattatcagtatcgcgcaattgctactaacttgcatcttactggatattgcatctgatgtgctatcccttcccggatgcatgccttagtggccttgggttcgatcttgccaactacttccatcccagtaggcacagcaacactccgaacatcccaatatcgactatgttcccgcctaggtatttgaaagtcccattacttagtacactcctcggcttctccctctatgccgacttcaggtggtcgaagcacgcatggctaatgatttagctcggcgggccttctggagtatcccttgcatctcagtaggacacaatcacaacgaattaggttttatccgccctgccttttcaatggccgcggaagacaggggttgttattctgtcgctcaccttgccgtccatttttgctttatcacggattgccaattggggtattctcacggcatgcatgtatgtatgtggtgtagctcgagtctactctgagaaaatggccttatcattgatgaacgctgcgactgactgcgagacatacgcggttgaccataatatgaacgacaaagaggcaaagcggaccgttgcaagcggccatccacatacaactcttttgccttgcatgcacatcaactagtccggccccgctagttctttgtttccaggacagtaatcccctttctttttaagtgaatgaatcgagcaggaaaagcaatacagcaccaaacaacgtaagtctcatttcgtggggagtcgggcggggattatttccaaccattcctggtctcctcccttctgacccagcaatccacgaccccatacaagggttgcagatccatgccatgactgggaattcctgtgggaccgaaatccgacgcgcatgtcatggcaagcacgacgtattcgtgatatatgtcccatgataatagcattatcagtacactgagggtactcgtgtctctcctgcttctggatactccagaggctagtgcatctaaggccccagagtgtccacggatacagccttggagacactcacaccaggtggtctgttctaacgactgcaccagataataagcatcatcatgccacacgtataaaatgtcacacgtcccgccctttcgccatccatgttaacccgggatatcccgtggacggaaaaaaacctgtcgagcggaataataaatcctatcgatgctgtcatactgattgctatgagtcacatccactattctccgctcgacacgtttctatcccactggggaaaggaaggttcatggcgcggctggtcaaccatgaaaaccttccccatcaaccagcacaagcatatcccacagcctcaacgtgttgctggtaccacgtcactatgccttgctgtcaaatactaacatccgctttggttcttacataccccacgtcaggctgagacatgtctcggtcgttcctgtctgtacatcagactatcgtatgcccttgcatgtcctcgagggagttcacccgccttgtggatgccgtgtagttaaggccgcaagagggacaccccagatattttagcacttttgcaccagtttaagtcgagttgttggtttctcgaggcattccctgccacatatgctaacggttctacattcgtacagccattctactggtttggccaagataactctaacaaacattttccgaccagaatgcgataactagccgatatgaatccgatggctggtctgacacacgcctctgcatgaatcaactgctaggagtgagctatgagaggggctactatggagtggcgggcgttgctaacgctagacaccactgacctgccgccaggtctggaaaactaacatgcgtggcggccgcctcttgacaggggcttggattatagcacgcactgccacttgacttttgtcagagaatgattattatctgaagaactccgattgcaaagtaatcctggcagagcagcgaagtctagaaaagactaggcatattaagtcccctcatgttccatgcctcgaattttgtcaatcatccagcttcgacttgacatccagtttttacgtactatattagtgcccttggtttgacaacaggaaacctttatataagtttaagcaacatctctttccccacgagcagaatgccgtatctatttactaatcaatctagcaagtacaaccgaagctgactccgttcatcatccttatagagactcccttcgactttagtcatttgagagccgatggataacattacctatgctgcaatcgcagccggcttttccattagtacctctatacacagatactaatatcggcaatgcacacctagcgacaatatattggggtatgcatcccgagatacgttgctcgggttatataggccagctgagccatggtatacaatgaattcaaggagtactcgaagcgagaaacccgggggggttcctttaaacattaagagcagaatcttaacacaatccttcattcatcagatatctattcaacaggctctgatcgtgctaacgagtcttcaaagagtcttagagtagccgcctcccaacaaagagacttgataaaacaagtcagcctgttcctcagactacgcgatttctgcatcgtttctgcatataagataccagtgtctggcctctggtctagtaaacagtattacatggatggactctttatgcgcaatggcaacgatgctcactttaagccagttgacataaccagcatttaacagcgggtacttaggaggtatatcaaccagacttctctatcatgatagcataatgtagtatcgttcatcaaaggctaaaatcgttgtgagaggattgattgccactttctggttcaatacgctcatctggacgatatatgattatgccaaacatttgtgacaataccttatagacacgattttcttcaagcttctggcatacgagggacaacatgtggaccaatgtgcaggagccttgatgtggtacttcactcgttagttcacagtatgtgatcaagtatgtaacagtgtttggatcagtatcaggccgtttcatgacctacaggatgttgttctgacaagacacgatcaacttctgctctacgacaagggaactgaagtcgttagtatatacaacaatactccagctatactcaaaacgggggactcttcacatacaattatatttttttataagagaatagattgatatggtgttctccagttgagggtatatatttttcttatattcttccaaatagtagtgtgtctcgactgcaatgggacagaaggttcttagaacgctggatggaaatgatcacagagtagatctatatattcagtaccccaattcagtagctgagctactgcagccccaggataaaccggtgcttgcaccttagttcatcttgatactcaatctcaacatgtaaacctagtactcgtaaacttggagatattgtctacttgaaaatccatgcaaatttgaagagctagtcataccagaagtatattcgagttttttactagtaccaagatcgtcaatatatatctcaccgcagcggcctgctactactactccccagtactgatgttgttttggcggtggtttacatccattcaagatattgttaaaaggtcaacaatagaatgtcgtcggagtatctgttgtgttgtagagtgatgaaggatccggtgaaatataccagcaagaaaagacataagctaaatgataaagaatgcgcagcgtcattcatctccataacttgtcgaggactagcgttaagccgggctactaagtgtttgtacgtctaaattaaacaccggaatagaccaacgataggggcacttcaagaaccccaattaatttggcacgaggtagtattgtatgtcttgtagaaattaaacatacaagtaagtatatatgcagaagtagtccgaagattaattcaaactactatcgtgatatgccaccttcctgagcaggagcttggcaaatatcccatactagtatatagtatctagacctcatctgttccccaggatcaaattgtatcccctcgacagctgatggaagccaattttactaaagaatgaagcaataagcccacataacctccctgacacccgcacagcaacaatctgacagataaaatacctgtccctgtcaaatcccacatgtccggagaaccattccacaagatcatatggaaccaaccagcctaaagatagacccattccaaaatccatctctctacaatagtcacagcaaccggcacgcaaagatcacaacatggatgtatccccttgctatatcatctagacctacccaaatgtacgatcgacataccaaggtcaccagagataccagatacctgatgctgcgactgtgacgtgaccttggtattctgcaggagagagagagagaagtgggtggggcgggaggacgctttcaggaatgtggcgagcgtagggttcggccaaggagtgcttgttttatatttagtaacggcatggctgattgagtgatcttagacatattatgtatgttgtttcagttctagatacaggtaggtggccgttactgtggggtttgttttattttccgatgctgggtgacgggcttgattgatagtcttgggggactttaggggatggcttaggagtgcgtatggagagatgatgtcgtggttagccttgttttcggggatttatattttggagtcatgtttattggaaagtagtagtgacactagaggcacggtacgtgcaatgacttcctgacctgtgtaaactatacaactatatacatatgaagttatagtggaattccatggctgtcagcagttgaggactcatcttgaccaaatacggtagtcctttccgctgaatatattttaactgggatggggcgggtggttacctcagatacaacaagccaagggggttatggtggtctatttcaagttcttcctccgccacatactctagtacgatatatctcaacatactgatagtgatagtttccatagcaagatagacctgtcccggctatccagaatatagataggccgctgtcagagtatggaatacggaggtgcctaaccgtccgttgtgtttcaccatcactgacagatggaccctgcattagttgactagcacatgacaggttgtttctcatgtcatgtgaaagagacacacctcaggtcgccccgtaagatcttacagtagaatcagcagatgcatgatcatcctcaccacatgtggtgagacgaacggctgactgctgagtactactccattacgttgttgtcttttgctggtgccagcagagctttgctttgtttggatgtttttccgggctaccggctgttttctccaccgtcaaaatcactttccgaacttaccaacaaacaggttggcaagatgttgcttggcgaaccaaaacgtcattcctccattccgtcgacggagatatgaagaagttaaaatagaagcgacgccacgatggcttctcaataagccgacaaagggtcctccgttccggagacaaagtagatagtttagatagtcgatagattgtcttacccctccctattgtacatgctactgccagctagctagctagccttgtggtccttggggcactgagaccttgttggttttcgctttcaggggggagcgcaaaggtgacctaaaaaaaggaagacaaaagaggggaagcgctgacaagcaagcaagaagaaaaaccgatttagctagcgtaggtaacctggcaagtttagtctttttttttgcataggggtgggcagcgaatgatgaagggtttagttggccaaagaatgggccaagtcaggcaccgtcgacgcgtgataggcccgatggccggaatgggggaaattaccggcgaaccttagcaaccacgccagcgaccatgccaaggccgactaggcgaaaagcggagtctttgaccacgcttgagtggaggaagcaagacgagcttagtcccctttcggtcgaggacgagtaaacagcagaactattagtgctctgccccaggccaactgtccacccacccctgcctgcactcggtctggactgcgcctaagcgcccttgcgcctcgttcctgtcgtgccggcacccaccggcctgcctctcccctgccctgtcctgctctgccctgccctgcactcctctcgcctcctcctccctccgtcgtctcctctttctcacccttcctgcgctctcttttctgccctttcttttccctttgttccctttcttccattctcccaggcgacaaacccccataccaacccctcccctcattcttcctccttccacccccgtcacgttctcttctccctaagcaggtgtcggcttcactctttcagctgctcaccttgctgtccgttcgttcgctgtaaccaacctggtcgattttcatcaccccagttgaagccaacctcccccccactcgccttgactacctgatcctaccgaccctgatacattctctccttttgtccaacgattccgtctccaaccggtccttcgaaacgaaaaaaaaaaacaaagaaagcagatcttactatctgattctatcgccgcgagacccttgttgagacatattgtaagtgactgtcgacgacaggcttgctgtactgtgccatatccagaattgacacggataccggaggaaacagtacaccttcaattcttgaaataacttcgcgtgtatcgaaaagcacgccgttactttccaaatactttgctgcttcggattgcatccgaagaccattcgaacataaaaaaaaaaaaaatccaactatcaaaatcatgttcaatcctatttctaagcttgttcggcgcggcgactctggaagcaacgatggactctcccccaccatggtcgatctcttgatctccctgctggttctcattttgctcggtctcgccctggtcggtgcacttcttgtcttgcgccgcaagcgactgaatcgcgaacaatccgaacttcctgtacacaacgggcaatgcgtgccaaaccaccgtcgtttcaccgtctctgcttcgccgaacgccaagacagagtccgttctggtttatgatgaaaagcgcagtcttatcgagaactcgtcgagtcccccgcccagcccggttcccgaaattcgcattacgtttccagaggaggaggacgaatccggaaagcgcaagtcgggccgagttgtggttgtgagaattaccgacgcaggtggagtgggcttggagccttgcaatgaggaacttccgccgtatcagtccagtgatgcggagcgattccagtcgttggatatcgagcgcatgggtggactcaaagaaaaggaatccaccaatagatggtcttagaagaatcgacctgctcaacgaccgcggtcatcggctcattcttcccatcgactgataccccttcgaatgaccgatgtcgcctttttgtcgcacctggacgagattcgaaaagcatgacgatatcccggcgaagatttgcctcgtttccatctccgtatttagaccgctctgcttcatattaccttcgcgacttgcacatacgcaaatactccgtcctgtttagccaccacgctcgccgtttgaccctgggtttcagtatcgactaacctcaagcgcgtcaagttatcaactgaccgatcagcgcatactggcccgacctctgtacagcaaggcttgctggttttccttgatattttgtgctttattctccttgataaggcgttcatttcttgtgcttggccactttggttctcttcaccctgccacgtcactagggttgaagagacgttacgcattggtttggttgaagttttcattctcctttgcattcttacttgcttctatcttacccttctcttctcccacgctcgccctctacaagtctcgggtttgcgttcaggggtgtcttacagctggataatgtatgtacctagtctgcctttgcattggatggccgcctcgcgaggtgtgcgccccaatgaatgcgtttatttgataaatacatgaactcttgatcagcgccttgacgaattcccaatttattggaccggtgtatacccgtccacatgacatagtctttgacatcaatgtgatatatggtttcagccgtgcttacaagatacacgatgaaggcaaattagcatcttcactcaatgcaaaatggcttaaaagccatatgcctcaataatgggtcttggaaaaacaaggagaaaatcccctttgtcttcccgccgacactacttgcccttaagagtggcaaacaaagactgaaagggtcttttgaaacattccaccaaataaacagggttagctagctgtgggactggaatcaggactggaattggagcagaaagtcactttatatgaggtactagatcggcttattccttttttcaagtggacttaggtcatcgaatatactcagtgaattgatgctaagcttgtcctgttccttcagcggataacgaaagacgattttcataaaggtaataatgtagtggatttctcggaagatgatataataagattggacccgagtcagtgattatacagctggatagatttatgacttgcaggtagtacaaagtgattgcgtcggaagggtattgtggaatggatgttgtttattaccatgaggtacttactggattgggttagcacgtggattctatgtttggtataacagcttatctaagatggttcaatgattctaatggtagtgggacccacaactcatactgtagactacttgacttgatccaagctgatcatagtcaaaagaccattaattattcatgggaacattattgattaatgccagctaactaaggtaaggagcttaccgactatcgcagattcgacctcattcacatttcgaagcctccgacactcactatagtcgagcagaggagagcgcagacaatgtctattacagggaatgaaccatctgggtaaagtacagaccaggcggaatctaccagatgaagtgtcgtccaatggaagtgcgtgtttgttcttcctttgtctcttgttcttgtaggttcaaatgccaccgcatgatttgctttcaatgatggtaatgtgttatgctatcctcgatagcggcagttgtcagaagatggcttgacgatgaaatgggtagaagggtactacccttggtgtggtggaagtaacaagatactgatgactctatgatttcagttacctcgggttcgaccaccgcacagcaagataggggatggagagtctgctagaagataggacgagtctgagacacaattgtgattgaaagaaatctcttgggacattggcatactgatatgggaaactcagagacactcgcaatgccggttgtctggactctacgggttccaccaccatacagcaaatcagaagatggagggtttgctgaaggctgattggagtttgagacaccatgctttgactgaaagaatagagaggaaagtgtttcagtgagattcggacttacgagatacacgaggtacgacaagaaagacactgtacacaatgcaatgtggagataagtgcctcaacggctgtgtccggcttgttgattcgaaagagttattgtcttcaagacaccagcaggtcacaagattgttacccagaggtctcgatcagctatacttagcgattagatggatgagaccgagaacaatatccttcatggttaacagacacagaactgatgcttcaacctcaacttataaagatgcccattacatccatggtctgagtgaggaaaccgctcaactcaactcatctcatcacatttcgtcttatctcgatctcatctcagactcccgtgcaccatgactactcctgctcttgctcctgctccagccccagctccagcttctactccagatcgcgttccagccccagctcctatgtttgttccctttaggtcgggcttgggtatagctctagacgcagctcgagctctggtccctgtcccagcttcgcctccagatttatgtttcagtttccttaaccctgtcagatttccgaaactaccaagtatgaagttgaggcgctatgtagcctggctactaagggaggccgaggtaccagcctttccatggggccccgagataacgcggatatacggaagtgagaacaaattccaagtaagtatttcgaaacatttcctatcccttcacattgtatcaccattgtcagctgctaatataataacctgcacagtaccacctctgggcagtaaaggatgaggaaatggagaaggccgtgcaagtgctcgacaaggctggattgccaccctgcaaacatggccgtcgttgcaaggtctttgaccctcagtacactgaacttccatttcccgaccatcattaccacacagaccacaattatcaagtaaacggtgtcactaaaggtgtctatctgtaccggaagtcccgacttttcccatctctccctgatccgccgcttgacgatccggagcctaaggaccgatgctatatgctcagttctgacagccggtttccggactggaacattgaccctgctgagcgcttgtctgagcaaaagtaccctgttactattcctacgcctgccagatatttggaagccatctgtctgctggctgtccgttatagggaagggcagcattcgagtgcattttgggacgaggaagaagaccggatgatggatctcctgggcgataggtttgtcgatgtactacaattgagtgaccttgacgagccatggcatgaatattgcaggcgaaatgttgaccgcatttatagcgaccgtgtggatgactggtgtggtcgtaaataccaggccctgatctatgctgatctgaagaaaaagggccagcttcaatcacctgagacaaaggaaatcttacgtactagatggttgagcggattcttctcggaacttgcaaaggctcagggtctgtccccagatgcactattgaagtgataattagctcgcttcatgcgcctcgtcgctctattcatgtcttcactcacacactttccctcacagacacagacacacacacacacacacacacacacacacacacacacacacacacacacacacacacactctctctctctctctctctctctctctctccctctctccctcttgctatctttttttacatatatccttacactcattgatagtctgtatgctgctcctaagtgttacaagtactaataataccctttgactttggaagtatgacaaccatgtgcatagtatacacgaaagtatgtttccagtaacagcaaaacaaacaggtgcatagagacaaaagaaccgaaatctaagcaacaagacaagcaaattgtagacacaaacagggcaaatgtaagattagtgtaaccaataagcagagacagactgaacggtagaaagagacggggaaattttataaagcagcaaacagtgaaggagacagacaaaacaacaaagaaccaaagcgagcgactgaaaaccctgcatgattgtgctttatccaagagcgacctcccaatcgaagttcgaattcttctaaaatttagcaatatattcttccgattcaatcagatgcttccactggtcaggcgatagacgctgcgaaaatgtgtaattgcaatcgagatttataagcttgatcacatcggaggcatctttctcattttgctccttggatctcatgccgcacgtgtaggctttacagaccatgaggtctagtttatcgatgagcggaagcctggtgtaacgaaattgcggcaggggctggaggcctgcggggacatacggcaactatatcggtgtgagagaagcgaataaatacatcagtaccctgtcttgtcacatcgtagagatccgcttaaggatcgaaagggaaggacttctagcctgagaaatcgcttacctcgtctgtcggaattatgcttatacggggacggccgagagccatattccagtatagcacacttgtcggtcgctcgaacccgttgatttgggtcaattttgctttgatctcgcgggccaactttgggggataaattgcgatttccaaattctgcgatactttgtcagcatatatcctgtaactatagcccttactagtgttctgtttgcctctgtttcttcttcgcggatgtagcagtggactgctaggtctcctacgatgagacattgcaattgatcgaagtcatcaattgcttgcaatagcggatcagttacaagtagtgtaatgaattgcatgaacgtagtgatgataatgtcattatgaggcaaggtgggctggaatattgaaacgatcgaggatgatgccttgtaaaggaaatgaaaaataagaagcatgaccataaggatgaagtcaaaaaaaggaggcattgcggacaattgggaactttctaaacagttgagtatgaatctttgtgaaaggactgtgcgtatgaacaagggggtaggcgatatgatacttaaagagaacaggttttggaagggcagttaggctaggttttatattaaagaagtagcctttggcgttaacccatcgttgaggaagggaaacaatgtatatgtggtcgtctatttccatgcttgagtgacatgattgccatcaacatgtgtcccgattgtggcctattgcagaagcactgaacccaagccaaaatttagcctcaaagccagactataacgaacctttccaaaaaagaagtgcgcccggacactttcctgtagctttcgtcataggaggactcaatgcgaagtaagcccatcggtgggccatctcatatgtggagtattgatcgttcttttttgaagggctgagtatatgggcgacgatctgggcccgatgaaaacaggccattgaaggccagtggcatgagactgtccaaagttcccggacccgtggagaagctcaggtctgaaacatgaaggacttcaaaactcagatccgttgcaggccatgaagagaacttctcggggcgctttcgggacggtggagagacgatggcagacaccgacgagactctattcaacggcggtaatgcttcctgacagtgtataggcggcaaaataatggagggtcgccctgaaaggaaagaaacacggggtagagtatacccttctatatgaggaggtagcgaaagtaatcttgccgatcggaggagcgccgtccgtcgcatagcattgttgatgttgggagtctcaatgaacaaccgtttggttggacatgtgatgccggagagcgcgtggtgatctgccccgtatttccaagacaatgtctattcatcagatcgctctccccttttactcaataaacggggggtctaagtctggcagcatggatgccccaatatcacgaatgacggtattaaagttcaagtataaccgatgatgggtgccattgccatttcagacatcacgaccctcaaagtaaaaggggatgagagaatgacctgcgcttgagagatagcgtctcagaggagttccgcatcttctgaaacatgagttgcagttcgtgttggcagataccgtccatgatcgattgatagtgagataccaacctagacagacttccgggtccggccagcatgggcgtccagccagccgatgggtctgatcgtcaaactgagcggagaggagagagcgtctatgagggtgtgactggcgagcaacagcgaactgatctggaacgtcccttctgtctcactcatgagatacttcggaagtgagtggtgttgaacgaaagcttaatgtagacgtgtgaagcaactactatgagcaacgtgctttttgagaggtggagatgtgcatgccagctttgtaggaaaagctgcaaggatcacctgaccgcgcttgtccaaagtccaccaaaatcaagagtatcacaaaaatatcatccgctcaggctttgcgtgggctttacacaggagaccgtgtggataagctgagacctgtcagagccaccgaccttgccccttccatcactacttacgcctagatagcgcttactagaatgcattccgcatctcttcactccgacccacggcttctctttcccgagacaactacctctttgtctcgtttggctgacgccactggcctcccacaagaaattccataagcgggcgtttcctaaatgctcccccttttccttttcagcgatgttcttttctggtactgacaaaatgctgtctctcaggtcacttgatcacaaaacaccgatctaccagagcacggtatatcatctatatacacagagcgtaatgaaggaatgtttgacagattcggcggcgatttcaagtctcctcacagtaaggaccacagcggtcagcgcgagatacctcccaggagcatcttacgaagggggtcgcctgtacgcctaaagccctcatctagacaccgacgcctcacaaggaaccaaacctcaaacagaaagggggaacttttggtaacattcgtctcatacggctggggactttccgttactgggtaaccatgcatgcaagttttcttggaaacgctggtagtgtgagctacacggatggtatgagcgatagccggcagcgcctcatagtgtgtgctctgtaggttctagaaggttgagagcgatcatgcgcccgccatattatcctaagcccagacacatgcattaaactttctattccggcatttgggcaactttttcttcagacagtgagactgattgaggatactctagcccttctgggttccttaggacactgatactctctaccacaagcatttgatgcatcttctctttcacaacccagtgattgttctttgtcggactgtagtcaggcatcaacagaccctccaccatctctgctgcctacggggtctctcctcttcttcctccttgaggatttatatagatcccaagaaaagttcacatgttacactttacttctgtaatatcttgtaactcttctctgtatgctaagtatagtaatttacatatacgatacttcacacactcctatacaacgaaccacgccccactggtagtcagtacctagcagtaaaagttaatattcaagtactagccccgtcagacccatgccgcggacatttagtatccatgaattgtcaatataggtactatggagcagaccccgcgaagcagtaatacaccacagactcccactcattgcccctaacccatactgaaaccatacacatattctcctaactcagcctatcagaccggattttgcgactagcagatcattcactgtctgatcttttactcaggctgaaatagaacatgactcaactaccgtagctataaccagtgattccattgatcgattgagttcgcgggtaataattgaaccaagcagtattcatatgagacgcttgatatgccacgcatctgttgtaggtataagcgaaccaactacgtataaggcgggtgcgggaagtggggaaccacaatctatcgatctagctactactagtgccacagtagaagtataggtgtgtttccttgctaagtctcccagggtctaagaatgggaaggggtttgaattgatcggctgtttcagttgtttctggaagatgtctacgttagtattctacgttgagaaccataatccgatacatctgttgacataactgattatttatttcattcctcaaggtttgccagagtgggccagggcagtaaagcatcgcaatggaaaagaaagagggaaaaaacaagacattgagaacagtgaactttttttcttcgcgtgctgcagggcaaaagggggtatttacacaagttgcaaagcatcggtgttaagatgtacagtcatccgtcgtagcaaaagggtcatgagtgagtcaatgaaatcctggaaagtgattgttgtttcttttcttttcttttccttctctggccctcgttcttccattcttctttgcctgctaaaccaagacagcatgtggctttcaacgaccccagcgcgaaaagtccaagttctgcaggatattcgtgtctgcagctgcgttccaatcggtagcaaaatcggtccggaccgaggtgttgcgcgagggcacttcttcggagaatatgttggctttggtgttgcggcgctgaccaggataagtcccttcggcagcctcggaactttgagcctggtttcctagcgctcgctcacgaagtctcttaatttcacgcaacctgttgcgccacgatgaaatgtgctcccctccttggctgtgccagacgagcgagaagacagacgcgttaagagcaagaatgcgaacgaacggggcaaggttcttcccggagataagttttggcaccgcggcaggtgatatttccggaaacccgggcttgctcatcaccttcacctggtagaacatgttctcaaaatccgtgcgtctcgactccgcactgccaggatcagtggtgagacggcacacagggttaataacgatgttgacaaagttgaactgagagggtatcgtgttgaagttgaaaggtgtattcgaccggttgaacacgatattgacgaaatcattcccgatgtggcgtttcttgctgatgcaggatggatcattatcaaagttcgtaggcatcattgtcggaacatggtagacaatttccgtaacccggtcacgccatgcataggtgaattggccatcgaaatctgcatgcaacccctgagtattaaatcgagcaccctggagcggaaccttggttccgagtcgcgacagaaagtattcgtagtctgggctgccgctggtattcgacaggatctctgcttcagtggtctggccattgtcgatgtatataacaccaatcttgtgcccatccacaatgtcgttgcggtcgaaggtgtttagtgctcggcgtgtaatgtcatcttcgggaagaggaattggctgcatcaccgtaggagtcgggaaagccgtggttgtcagctgaagcatgatatggcttggaaggacagcagtgcgcatggtgtcagaatgcaagtgggcatctggcgtgggcggaacctggtgaggaaggacgggcgcagttcgttgctgaaacattgcgtaggtagttcctgacgcttgccttttggtgacctgagtcaagccagatactccagccgtctcaacagtcacaatgctcatacctacaatccatgacttcttcactacaggcccatcttccggagtcggaggaaagtttgggtatggtatagtgtctcccaagtccgagaaagctgctctctgcatcaagtcgatgaagacctggcttggctcctcaaccgtctctctaccgtgttcatcccggtatatgagtctgctagttatccaattcacgtgcttggctcgatcctgcaatttcaatgaaagaaaccaaaagatcatgacatgatacgtaagagtatagatgtatctggacatcccatcctggagtgaagaatcagacgactctgcgggcgaagccatagtatctcggacaccgctcccaagccttgccggaacctgaacattcctggtgggcgactcagaagccttaaaccgctgctctctggaggtctgcaagaatcgaatacagataccaaaaacagtgcgaatctcttcctcacgtagattaatatagacatcaggaaggcgtgcaagaagagccaagaattccaagatatgcacagcaagattggacatcgtgatcactttggacattttgtcaaggattccgttgagggacttggtcaccgagagcggaatttcatgacaacagacagagagtgcatgaatgcatccgcgcgaagtaccaccccatgatccaattatacccatcatgaatgcgcgaacaagctcatcttcttcgcttttggcaaaatgttcatgatagctgattagcgagcagagaaactcgaagatgtagccagccacgtcagtcttcttcccaccagtggacggtggcggctcacggaacgtgtcgttcttcacctgatcgcaaaggatactacgcagtaatttgatttgaggaactgcgttgctgaagagatctttattctgaagttggcttgcaagatgggtgaggacgtagctgtagagatcccagttggattcacgttgcagcaatgagatgactgtctcaagccacatgtttgccttcaatgcgaccttttgcgcagattctgattctaaggtgtgactcgtttccggcgtcgcataagcgtatacgaatggactcgactcatcggggggcgcttcaggaagggcttgcggggtcgcaaaggtccaaattggaggcgtcagtcttgaagcccgaatgggaatgcttggattacgtcctgacgacctagaaagcaccgatggctcccgagccgaatgccttgcatgggctgctggtcgcccttggtcgctatcaacgttgtgttcaacagccgagtcaccctgttgcttggagcctgcctcgacatttcgcccagaaacgttcatcgtgaaatcctgttcagagacggaggtcacggtaatcgagcccgacgaatcgcatcgcagtcggaataatagctttagtgatgtcaaacgcgagtccaccggccgctccgagcattgagctatgttcaagagtgcttcatacaccaaagccgccttagacgctgacatattaagggatcggagaaacatcctgacaagcccaatagtgcaaatattggccaaggacagctccataacactgctaaaagaacggcgttccgaagacaaagttgtcgaagtctcagagccgatcataccctctttgtccaggtctttactcattggcgcgcttaacactgccaccaagcgcttgaaactttcattatcactgacgagcacggaagcatcgacaaggaaagagaccaaagattctagaaacaaaatatcgtcttcctcagcaaacctttccagcatgaggtcaaggagtccgtgttcctggaagaggaccagagaatcatatgttgagaaagaatccttcacagtatccaaagccaggatccgaacgtcggatggtttgctgcgggagcggatgaagcatcggatgagacgttggttctgctgcacccaatccgggctctcgggtgagcaaaacccttcggtgcggatagtgttgaggacgagctcggcctggggaggctcgatatgtcgacaggcattcattaggaaacgggtggcatctagccgctgctgatgattcaagcgatcccaaagggcttccagggtagatgcgatttgaatggtgctggccagaatgttagaccgtgtgtcgtctaacacgctgccgcgcggctgggcatcaggcattgtgaaggaggattcttcgtgttcgtcaacggccctgagagagcatgcattcaataaattcacaaactcgctccagtcattgttcagggccgtgtgaacgtagtcaccttccaaaacgttcaaacacagctccaagatatccgcttccaaccggccatcatccttctttacaacaacctgaagcgactctatcaaatgctcgaactgaaatttgggtattccatcttgaccatacgcgcgcacaagatccatgaaaacataaaccgctcctcggacaacgttgaggttacgacacttttcgccgcaggactcccttagaaaagcatgtaaattttccatcatctcggactgtcttctcgactttgctagattccggaccgctctcgacgtgggaccggacaacgatttgacagatgcatgaatgctgcataatacctcgagcatcggaacaaagcttccattcggaacgtctgcataaagtattaccgcatcaaaaacgcccaaggagttcttaatgtcagcagcaacgcttgtctttcggcaaatcgtgaaagtctgttctaacaacatctgaacttcttcgtcgcttggtggcttccgttgtagtgtgataagatcgatcgcgaattgtaggaggtcatctaatacagcgccatcgtatcctagcccgtttgttttgccgactttggttttcctggctttcaaccgcgcagatgaaactaattcgtataatggcaacaagcaagctgatatcacaggaagaatggacgaggctgcaaactccaacttccggccatgatccgatagggctatcagagactggacacgcgcgggaacaacatcattgtctgatggctttgctatcgaatcgaagacgatgcgccgcgctgctggcgacaggtcttgccgtgccgcaaccgcttccaacaacatcgaaccactccgtcgagcttcaggtgaactttcatggtggaagagatacgcccctgcttcccagagagcaagcgactgttccggagtgaaccactggagtgactttgatatttgttccgcctcgtctacagcgtggcttagagactgcctctgagccaacgttcggactgcggtatcgaaatcccgtgcaccagaggtgtcggaagaactggatacgacgctgccacgatgcattgagtcaaatcccagtacagtccgactgattctgcgtccatccgatgaatgcgataaagaatcactgctatcgtggagcgagattggagaaggtgactttgggcgggagatgcttagtgacttgagtacgtcgacaaaacttgatgctgcgtgcttggtatagtacggggattgagcatcgtcagaagacatgcgtcccagcggacgagggggtgcgtatgggtttcttcagggcagaggattattatatctgtccgatgaccggtcagcgacgggattgtgactagaggccacggaaggtcaccggtcagctggaactgaccagctctacatcggcgatccactttacgcaaaatctcacataccattggcaggtcatatggatggatcagggacgtgaaagatccgcaaaggcgtatatatgaggcttttaccgattgttacactcggagagctggtcccagcggcatatcagtgggcaactagtagtcgggcaaccggggttggaagatcggtcaaagcatgtattccaatttcaggcaaacaaaggaatgctgccgaacaaacacagccgagagaacaaagagacagggaagctaagttgatacttggagatataatcagagcaaaagtgcgccaagccacttttcccctccgagcagcgatgatgatgatctggcggaggtcggcaaggctttgatccgcacccggtcacctgatgggcagaatcaccccgcgaccgccgctcaccgcctggattttgcaaagcaaccgccaaacaaactgccagtccaggaatcgagcttccacccggcttttactggagccattctttaatatacccttgggttctttctctagagcaacccgtcctagctctgcaagcttttccctttaatcttcttcaacaacctgcctttaccccttaatttgtaccactttcccacatattccacctgcgccgctcgcttggcttcttggtaacatccccgcttcaaaatggctgatggtcttggggctgttgcgcagctcctcgaggcaagcttggatcccaggcagaacaagcaaggtcagtaaatttggtcaccctattgcctcgaatactcacttccgagccatttgcaagctttgatttttacattgcattaatcaaagcatccttaactgattgtgaaccagccgaacttgctcttcgccaggaggaaaaaaaaccgaactactctctgcagcttctccagatcacggcttccgcgtcctatccttacaacacccgtttggctagcgcattatgcttcaagaactttattaagaggaactggactgatgaagatggaaactacaagctccaagcggaggaggtaactaccatcaagcgggagctgatcagcctgatgatctccgtccccacgggcatccaaacacaactgggagaagctgttagcgttatcgccgacagtgacttctgggagcgatgggatacacttgtggatgtaagttagagaggtgtcatgttttcggcttgtgcgcggtcaattgacgtccccaggatcttgtttctagactccagccgaacaaccccgctgtcaacaacggcgtactccaagtcgcacattccattttcaagagatggagaccccttttccggtcggatcagctgtacctggaaattaatcatgttctcgaaagattcggcagtcctttcttggctctcttcgaggtaagttgcattgtattctaaaacatgggccattacgaggccaaggatttctgacagcaaactgacttccttatagggcttggatgcctaccttgaggagaacaaatccaacaaagaaaatcttgttcagggattcacgcaactcaatttgatgatcaaattgatgtatgacctttcttgccacgatcttcctccgatgttcgaagaaaatatttcagggatagcctcgcttttgctcaagtatctgacttacgataaccaactcctgcacaccgatgacgataccgaagcaggacagctggaatttgcgcgtgctggaattttccaagtcttgactctgtacgtgcaaaagtacatggatgagttcaagcctcacattggacaattcgtggaaagctcgtggagcttcttgacacttatcggtcaagaaaccaagtacgacattctggtcagcagggctctgcaattcttgacttcgattgcgggcatgaccgaacatgcggctgtattccaggccgaagacaccctcggtcagatcatcgagaaggtcattctgcctaatgtcagcttgcgtgaatctgacgaggagcttttcgaggatgagcctattgagttcatccgtcgcgacctggaaggctcagacagcgataccagacgacgtgccgcaaccgacttcctgagacggcttgccgagagatttgaggaatccgtgacgagagttgttctcagatacaccgagcactacctttctgaatacgccaaggctcccgccgctaactggaaggccaaggacactgcaacctatctcttctctgcgattgcagcgaagggaactgctacgtcaagccacggtgtgactgctacgaacaaactcattagcattaccgatttcttccagaagcaccttgcggctgatttgattaatgatgagggtgtacaccccattctcaaggtcgacgccatcaagtacctctaccttttccgaagcattatcacaaaggagcagtggcaggaagttcttcctatgttggttaagcacctcggctcctcggaatatgtcgtttacagttatgcggctatcgccgtggagcgtgtcctctacctcaccgatagccagggccaaccgatcatttcccccgctactattacaccgctgtctaaggacttgttggaacacatcttctccttaatccaaaaggaccaggcccctcagaaagtgcaggagaacgagttcctgatgagatgtgccatgagagttctgatcgtcatcaaggagggcattgtgccgcacaccgacagtgtccttcagcacctgatcgctatcacgaaaatcatcagcagcaacccaagcaaccccaggttctactattttcactttgaagcgctcggagcttttatccggtacgtgattaccagcgattgctcgaaattacagtcactaaccaatggattctaggtttgcggcccctgccaaccccgacaaactcgaacaagctctttacgctcctttcgcagagatcctccaaggggatgtgcaaggtcagttgtaaaccatagggaatggcactacgagccatggctaacatatgatcagagttcatgccttacattttccaactctttgctgcacttcttgaggcgaacccctcaggaacactacctgactactaccagaacctgattgccccgatccttatgcctgtcatgtgggagtcgaagggcaacatccctgcgcttgtgcgacttttgtcgagcatcatccaccgcggatctcaatacatcatccagaatgagcaaattgctcctgtcctgggtatcttccagaagctactctcgaccaaggccaatgaaggttatggattcgacctgttggagtctgtggttgcaaacttccctccgtatgtgaagccccggtgtgattgtcgatgcattaatttaccaactatcttccagggcaacactggaacaatactttgtttcaatcatgcagatcatccttactcgcctccagaattccaagacggagaacctgaccctccgattcgtccgtttctatcattttgtctctgcccaggatgacaagggctacagtgccgacttcgtcatccaagtgatggataaggtccagcccgagtacgtaaaatccaatccaagcgtgggagctagcatgctaactgcctccaggctgttcactcccatctatctgaatatcatccttcccgaaacacaaaagctcgctcgtccgttggaccgcaagaccgcagtgctatcatttactaaaactcttgctaactcggaagcctttgcgaaccggtacaagaagggatggggcttcacatgtgaggctcttctcaagcttctggagctgcctcctctccctgccagcaaggatgacatcatcgccgaacacgatgtggaggatatggcattcggtgttggtttcacagcgctgaacactgtgcgaccacagaccagggacccttggccagacacgggcgccgacctgaaggcctggactggcaagtatctgaaggaagcggacaagaagcacaacggacgcatttctggctttgtccaggagcgtctgggagccgaggcgaagacagtgctgcttagttatatcgcatgagcaggctaatggggccaggtgcactatttactgggatgtataaaatcctatgtctgataactcgaccgtctttgcattttgccaaaaagaaatcatggagaaagtgttgactagcttcaaccgctctattgcatgtccttatgaattgaattacacttagatgacactgatatgcctcaacttcctcgtagtcgatttcccaagtactagtttgttcccgttttatgtaagtttaactacgtttggagagcgacagcgtgccttgctttagtgtgcgaatgtaaaacggtggcgcacgcgatgcagaagatcatttacctctggctccgcgcgctgtccgggacatgctcctgctgtagattttgttgggctgccagttgatggggactctgtatgtctgctccttctacttccgattcgtgctttgaatcagcggactcctgtgcatcgtcctcttctgcctcttgactctccttgccatcttcgagctcacgatacttgcgccggctcttcttcattttactggccttctttttcctcgcgcggtcggccttgatggccgcgcgactttggtccccatgtaggagctcttccaccttgtcagcaagcagctgacgagctatcttctcattctgggaacgggatcgtgtggcttgagatttgaccactacgcccgttggtttgtgtatgatctggacggcagagttggttttattctaggcattgaaaggagaagcaagttagataagttcaaacagccaagtaagaatggaaggaaatatctggttggcatacaatcttttggcctccagggccagtacccttgaggtatgagactgtcacgtcggcatcttggatcttcaggcggggaggtaatgctttgtcggcgagggagagcgcagagagggtgaagaacctcggggtcgggaggtaattggatttgagaaaggggcgtgtgatgtagggggtcaagtggaggggacggaacatggtgatctgaggcgcctactactaaattccatctggagtactcagcgtaggctcattgcttgattagtattacatgaagctggctggtaattggcggcggcggctgctgctgctgcctgctagtactaactagtactaagatgcccgcggcacgagaaatcatcgctggatctggacccgttttacaaaaccataccattgttaccatcatttggtcggtgactaaggcaattagtacagcatcaggtggcttgaagaatactgactaagcgaaaacaccatcaactgaggtaaattgctgtttatccgagctgtaaccacagttaacgactttataatatctctttctgctgcactaccccccactgggtagtaggaacacaactgctttctcccctcttcttccatcggaactgcctctctggtttccaaccaagatggaggattggatttgtctcaccctttttcaccctgaatctgcttgataggcctgaccgagcggagagggtgacgtacgccgcccagtggatgcgcggacgacagccatcaccacacgccaatcagggtcagatcgcacgggaaaatcctccccatgaagggaaggcaggcaggcatttgttccagtgaactggatgcttgagcccttcgcactggctgcgggagagagagtctgaaactttgcacgctgcaatccttcggctggaccctgagaggaggaaaaagtggacctggtttggttctcttccgtggcggtggattgatttgacttagtctctgcggccgatttgaaacagtgtccagatcgcaagcatggacttgacgggggcgctggcctaactaactcgtattcgttaactattcactttaaattatatgactgtctgttccgtccggctgtgaagctattcttagttgaggtggccttcctgcctattcttccccattcctgttcccctggacttatctgagcttcttcacatggggggctaattcactgttctacttttctctccccatcacagcctccggccaaatttctcctctttcgtccctttcaccgactggactgaccagctctctgtcgatcaacccacatcgtgttgggttttatataatttttccctattattctttattttctttttccccctctgtgacctgccggcttagtacttgatcttttcttccatcaacaaccgactggacagatcatggatgcctagttgaacttccaaattatctccgtctttctaatattccttcccccccttcccagcgcgcttggacaaattgcttcatcaccgtgggcgactgcgataatactccaaaggactaccagggcaggagctaatctcacccctcatcaccgttggattctgcgcttttctccgcttgtcactttcgttgacctcctggctcgcgggcggtccccctttcgttcaatcctttcaagaaaaaacccgcctctctccaccatgactctcttctggatcctgaactctttcatgcgctgggtgcgcttgaagatatatcaatatgaggtgaccttcgccgtgtacatgcttacgcctaccgaaaagttcatttttagtacgttcccccggttggaacctggccacaagtttcgagcttgcatttcttgcattaaagccgcatggtgctaacaaagaacgttctagattcccttctcctcactctcctttcaatgattgtaaccggcatctacgtctaccttcccgatcatatccgatccatttatagtcacctttactactactgggccggcgagcgtccgtttatctctgcaagccttccatcaatcagctccgtattccgggagaccggtacccagactctaggagtgatgtacgagacggccaagaatgctgctgcgacggccactgctccaatcgctgaactgtgatatctccccgctacagtagcgatacgggttggtttctcggtgttggtgacgattgtgggctgctgggttgggtcatttggcttctctgtttctccttgtgataccatcggggctttcttgcattttgctattcgtatcagcatattgctgccattaatcatcctctatgaccgcatacctctcttgtcctcgagcatggattgcatcagcatttcacgattcaccgtactgctcctccaccgaacggttcctatcggcgttgtgaagttgtttcatggagtttgaacgatactgttctgagcgggccggcgcatcctaggagttccatcatcttcgttttgtttcctcccctggttcatactctgcctcacgcatattgtttataccttatcgaggcaatcattgttacgatcacatactttgctgctcttgttactttcgcgactggacgctggggctccactgactgcacatcttataacatataaactcataattctgtatggggcacgacagtaacgccgaggatagcaccaaatcctataggatgctatgatgctacaaagttttgcaccgctatgctcagccgagcagaaacttttgctttgatattgcgccagactaaaagtacatataagtttaacatatgtaaacaaaaaaaattgaagttacccaattcaatcatcaaacccatcgcccaaatgcaactcccgccatgctcagagaagagtgttatacaaaaccaaaaaaaaaagagccaccaccgtagatacgcgagtaggacacggtgcaacatcgcttccctacccctcttagtcgcacatccatacacaggacgcgtgtagcatgtttcaaggtatacatagatgccggctccgaacgcatccgcgactgtatttcccgtttcctactctgcgtagagactcactgatagccccatctctatatcaaacacaaccgcaccgcatcaaattacccgagtagttggtttactctgcattcgaagatgccgcctggatctgagccggagcctgagcctgagcctcagcctccaatgcctcgcgccgctgtcgcttctctcgcttcactgcatccaacatgcgcatgcgtgacaactcgcggtcaatctcttctttctcaaggggaatcttgtgcgattgctcggttgtgggccagaagccggggacgctgaagcggtcgtcgaggttcgtgccgaagtagtacatccagccgatggggaagatgatgtacatgccgaactagaagagattagattctgcctcctttgggaatgaggcattagtgctttgcgtaccttgaagacctcgaggttgcctccctggagtctgcggaggatggaggacatggtgggctgttgttggtgggatggatggatgggatcggatggtaagtgtggctttggtatttgattccacaggtgtgtatgggtttgaaataagtgtactgctccgggattgagtatgctaatgtcgagctacaaagttgtgtgaattcttcttgatccgtcaccgacgacaaattatctgggctgatcgttccgatacgacggattattatcacggagcttctgacatgccgaccacaccttgcaaacagagcaaacgttccacgtgctacaagtcaggtgacatcaattactcatcaggactcggcctgccgtgggccgaggcacctaagcctcggtccgtgggtttccccgcataatgttgatgccggttatggcagatccccgttagtagaacccacctctatctatttctattatcagggactaataatactgcaggttctcctggaattgcttttctttagaactgtcactcactgaatattttccttacggccatctgacgtgcaagcgtgcatttaggaaaggttacacaacggttctttctctttagagcggctctaaaccctcctagtctccgatagtaacaaacaatctatactcacccctatctatctacacaccctctctaacagcacacaacaccccgaacatcaacatggccactaccaccgaagaccccatcaaactcacctaccaaggccgtctggcaatcatcaccctcaaccggcccaagaaactcaatgccctagacggagacctctactacctcctcggcgaacgtctccgcgaagtagacaagcgagatgacatcttcatcaccatcctcacaggctcaggacgctacttctccgcgtaagttttccctttctcccacacataaccacaaataccaaatacatcctaatcctccatctccagcggcgcggacgtaaactcctcccgccccggcggcggcctcggcacctccgcacggcgcgacctcgcccggtctttcgtaataaacaactacgacatcacacacaccttcgcgcaccactcgaagatcctaatcgccgcgctcaatggccccgctgtcgggctctccgcggccctcatcgccctcgcggacttcatctacgccgcgccgcacaccttccttctcacgccgttcgcctcgctgggcctcgtagcggagggcgggtcgtcgcgggcgttcgtggagcgtctgggcatcgcgaaagccaacgaggcgcttatcatgagtaagaggattacgtgcgaggagttggtggcggctgggttcgtgaataaggtgtttacggcgccgagtgggaagagcgatgatagtgaggggttcttggggctggtgttgcaggaggtggaggagaggttggggttgcatttgaatcaggagagtttgctcaagattaaggagttgattagacggcccgagagggaggtgctggatcgccagaacgggttggaggttttcggggggctcgagaggtttcttagtggggtgccgcaggaggagtttaggaggttggcgagtggggagaagaagcacaagttgtgagacattgggttgggttgaagggtatatagtgagtgttcgtagtacatatgggctagatggtttgtggagtatagaaggtagagaggtggaggaggttaatgcgagtatcacttttagtattcggtttttagtgccttgtccctctttcgctatagtcctaacgccgccttaatatgctgagctgcgctctttggtatgttcgtaactaagtatacaatcgatgcatggttggaacctctattggtcttcattgtccgagtcggactcctgcgcctgcttcgccagaatgtcctgccatttccccagaaactcgctcatgcctccaggaccggagatagaggcgtcgaccacttccttgggcagcttgtgtgctgagtactgcggggtcgtgaacgcatacgcctccgggtcatcgcgcttgattagcctgaactctgggaacaatggtgcatcatctacattctcgtcttcggacgcggactcggactcggattcggacccttcatctggctcagcacctgcctccagtccaccgtttccattcagagaaagccgcacaaattgctcttccccattgtcgtcttcctcccggatacccacgggatccttcatatgcagaatctccatccaactgaagagcagtgagtcggtcctctccgcccatgggttgatatcgataagccacactcggtcatggggaggcgggatatagacatcaaacacgaagttagggtccgtgaacgtatccttcagcttttcatcgaagaaggtctggatccgagaccggagagagtcccgcatggggaagaggaagtcgaaatggttctgatcacgctggcacatgcacaggaggactctgttgcgcacgaagcaccggaactcgagcgacgggttgaagttgacgtatttgcgaagaacgaggtagtaggggatttcggggggcgttgaggaagaatcgtcggtggtggtagtgtcagaaacgcagtcgtcgaatgggtgttccaggtcatggctgataaagtcactgcttttcaagaggaggtagatgtcgttggctgtgcgacattgcgtgtcgttggtggcggacatccacgtcgcatctttgggcgcactccagttcagcttcggcgtcactttaccgccgtattcggtgattgtggacttgatctggttgtggatttcaggccattcgactgacgggtcgggctcctcgtctgcgccatcatcggagaatgtgtcgaggttgtcgtcgtctgtcggcggggcagcttctggcggcaggacgataccgtccgctcggaggtacttaacgaagggggcagtgagacggatagcgcgggacttggggaccagggtgcggtatctgcggcggtgtatttaaattagtaccttcattaacgtatagaggggttatactgggcacataccgaggctgccagtggtgataagagcagtgtaggatgtgagaataagtgactggagggaaaggcagtcttgttaattgctcggtaggagcttcggccgccggagctggcgcctctgaatcaatatgaggcatattggtttatgcgccgcaatttcggaggattgtgatggtgaagatggagataaaagttatctcgtcgatcgcgcagtccgcggggtctttttcttttttggggatgactcaagtcacttacccgaaatagcatggttgatacaggcatgaccgtaccgtattgaagccacgtgctgcctcaggcacaatggatcgtcatccagtgattacgggctgcgtagcatcattccaggcagtgctccggctggcattgatgccctgcattgttggcttgtcccgccagcgtcctttcctttcaccatggcgtctgatggcccggatccccagtcattgaagtcctggcaggatgcatttcactatccaattcctactgtgcgccgcgtggagcaggagctgcgccgggacatcgcaagcaataaggagaagctcagggctcttgtcgggtatgtgaaagcaaaccctcatgatatctatatgcaggactaatcatatatggcgcatctagtacgagataccgagaacttattggcactgccgagacgatcgtgtcgatgaaccgcgaaatggaggatgtggattcgacgctggccgacataggacgaagatgcaatccacgcctgatggagaagatgtacacacattacaatcagataaaggatgatagccatgatgaaggtatgttattgtcgtgagtttggatttggttacaaccaacagctgatggggattagatgccgcgaaacgagcgctcggagggcaactggccttgcttcatcgctgcgcatcgtcaatctccaagcttttgcgacgacgcggctccgtcttgcttgtggcgaagcttatggtcatctctcgccttctacacaagaccctgtcccagcagacaacggtaccaccatttgtggaggacctgcgcaatcaattggcgtcccttcggcgaagtctgttgaggaggctcgaaaagcgtctcgcgtctgctaagtatgcggctgatgagattattgaggccttggcagcgtactgtcttacaactagctcttcctcagatgacgctattcgttactttcaccaggttcgcttagatggtattggaggccagttggagcttgtcgacccgtcaggcgagaatgtcctgaacagcttacgactatatgttcggaccctccaaacttctaagatcctgctatctcgccgtttgtctgatgttctaagcaaactgaaagcacggcccctgctgacagaccctgaaattcggagtttggacgacctagacctcggtgttctgggacgctgggttgccgcagatgttaataacttcacaccatggatcaagcttagtgagttatcgaagtcggatgccgagaagacgatcaagcaatggtccaaaccggcttttgatagattcttagacgggtgccggggcaccctcacaaactggctggacttctcgaaacttctctcgttacgcaagcagacattggagctctggctatcttcccggagctcgacacccacccattcatcgttacaagttctggagggaattaggtcggtctttaatgatcgacttaaagggattctgtcagaacaagctaaaacattggatgtattcggtcaaggcgtcgcttctggagtgtcgcattggggcgacagagcccacacggcttcgcagtcactttgggccgaggacttgatttcccttgactattccaacggctctgctgcgttcaagcaagctgtcacgcacagactcctgggccgtgatgatgacgtatccgctgtccttgagaaataccatggatggttgtctgtcatcgaggagtccagggagtctatcgatggcctacggcagatacgttgggctgacgtcttggacgaaggcgaggacgaggatcttgatatcgatgttcctgccatgttaaacgacgacgatccacgactgctgcgcgaagcccttcaggcggcaattgagcaagcattcgaaacactccaaaattcgctcagcacaaccttcgacacacttgagaagccgggacaaagcggtgaggccgcttttatgctgaagactatccgactggctcgaagagatctgcctgcccagttcatttcgagcgattatgcactgtcccagagcattgtgccggagttgcagaaaattcttgctactgacatagtcgcccgcacaggaccctggaagtctccggctacttcgaaatcgaagtctggaaaagtgccaggtcgcacactttgggaaggtgatcctgaaatccctgtccagccgacaccatcgacgttcaaatacctgcgtagacttgtgcgttctatggatcagtacggcgccgggctttgggatgcttccacaacccaaacgctaaagagcgccatgctcgatgagatctcaaaggcgatcaaatcttcccttgagaaccttaactcacctgtcgatcatgaggacagcaaaaagtctgcctcacaggatgatgaagagacggaatcggcacggaacggcgaggatagcgacccggcgaagccagaaactgaaagtatcgaatcagacagtgcggccgatgtcaaggaccggaagatacagctatacttcgattccgtctatctgaatgatgcgtttgcggttcaacactctgagcgcagccagttgacagaagtattgggtacacttcgcagcagtctcgacttgcctgcgaaggcgacaaagaacctagagaacgctgcgcgcgagtactggaaacggacccagctattatttgggctcttaaccatgggatctgagctctaaacaggctgccagtggcatgaaacaatgtatatagatcataaccatatcatcatcggacaatccagttcataccatcttcatacctcctgtgaccggccaatgagcgtgcgtatgtataaccttcctgatcgggcctagcggccgcgggggttactcaccgcccacgtcacgtttccggcggtgacgccgacttggccgcgggaaaacgagatgcgttcatcgttcatctccctctttctctcctgaccggctgccttgtcttgttgcacctctcatccttgctccttcttcctcctctccccttaatcccttgtcaacgcggcaaccatggcggccccaaggcttccattcctttacccaaatctgatgcgcgcagttcgatcctgcgaaccccatacctaccgctctcttcgcctttcatcccgcaaccagtacgctcccttccacaccagtccacgacgaagtcaggaaacctatcatcgaagatacgggcctgccgcagaagcgaacctaccaccgccctccaaacctaaagatgaaccagctcgtcaacagcccaccaactcttcatccgggaaagacaaggacagcaatgctgcttcatctccgaacccaaccccaccagcgcaatcgcagccaaaggacaccgacaccacctccgaggcctcatcacagtcgcaacaagacaagtttgcctctgcagacacagaactgctagacgaggagaaatccgcacaagaacaagagccccgtgaagactccgagcccatcctcgacgcccgtgatgccgatgaggtcaatgctatatcaagcgaaagaccccccgaggaatccatccatcttcaccatccactcaaccagaaccctctcgagggtgtacttcacatgccatctccttcatcctacctgactacaaccggcggtctcgcctccgaaaataaccacccgaacctcgccccagccccttacgttcaccactttgatacatactcgctcgttcgcgacctctccacaggtggcttctccgaagaacaatccgtcacaatcatgaaggcagtccggaccatcctacacagtaaccttgatcttgcacgccaaagcctgacctccaaatcggacgttgagaacgagtcctacctgttcaaagcagcttgctcggaactccaatcctctttacagacggccagaaactccgaaatgcagcgtcagcggacgtcccgaacacagctacagcacgagtctgacattctatctcaacgcttgaaccaggaactggccggtctgaaagacgacatcaagggaatgttcaacgatcacaagatgacgacccgcgaacaacagcgaagcatcgacacctctgtacaggaactaaattacaaaatcactgtctctctgaacagtgacggcaagagtgaaattgagggtctgcgctggattctaaccaggagagctgctatggccgttgctactagtgcctgtaagtcacattctataccttccttacactccttctcaagtttaatactaatatcgtacagtcatgatcatctgcttcctgaaatactactccgtccgcaaggcgcaggagagcgcggagaagaaaaagaaagagcaagatctcccagtcaagggcggaactaaagaggcccgagcagcagctgccgtcgccggccgggatcctctcctgcccaagtcggcgccagttccgggggttcatcttggagagtcccttggctgaacttccattaccctcctttcattcccagttcaaatgattttaccgattgtacaacaaccaatccatctacttcctacttctcctgtatatcatccattcttataccagttatagattttctccttttgttttcttagcccacatcacattgatttatctccctcctggttggtgagacatctcgatacccccacgcatatatctatcttttgacattctctctctttctctctttcacattcagttctctactgttccctggatggggacaatcgcaacatatagacgggttccatcgttcattatccttgtcatatcatgtcatgttaacatttcaaatcattgtacctatacctatacttctctatcatctttaaaaaataactctatatatgcaaatagtatgggcatgtatctcataagcgcaacgctcgccgtcatgacctgtgcacgggacccttccttccaagtactagccagttatccctgcgttgtcgtcatcatcacatctcgtgccatgcatgcgtgatagaacatgtcatccggcaggagccaaagtcactcacgcctgtccaattaaatttatacgggggggtgtgtaacatgagtaaaaagatgaacacaaaataaaaacatgcaaagaagaaagcaaagacgcaaagaatccaatatagtatactagaagtcgaacctcagcgcaatactaggcatggcttgctgctcactgctggactgcgtgctctcacgggcatgtttattggctcccaaaccggcttccgcactgcggaggatttcctcgagtcgagccttctgctccggactcatagtagccacgagcgctcggaacacgagctgattggctttagccagttccagcagatgaacggcggtttcctgatagatggcctgcccctcacgttttgcgcgagaaagaagcgtcgacataattagggagatggcggtgggcatctcgtttgcagggaatactgcattgctgacacatgcgacgagcgtgcgcgcaatgactgttttggagttttccgggtcgctggggacgtcaccgttgtctgtgggacagccgacgtagaaggcaatgagtcggggtaacaggtagcgggcaatcacttcgctagtgggggatctcgggtttgaggtcaggagaatggagcgaatgcaaccagcagcaacgttcgcaagtccaacatcttgaaggcagtccaggagttcatccagaactcggaaaatcacaggatcttgaggtggaataatgtgtccaccgctcgttagtagaatggcaatagcaaggagagtgttcttcgcgcaggggagagaggactcggactctcgtcgttgcgcaaaagtcagggtagtgaggaagcgtgtaagacagccacgcaactggcgagagacgacgctacggttttccgggtgttctggactgacttcgggcgaattcgctacgctgctgatgaagtgtttgaaagtcggtagagcctgaggcacgacctccgcctggcacagcccagtcgccaagatagtgctgaaaatgtgcaaaatgcatgcgttgaggtcgttgcggatgattgaggggaaaatcgaggcaacattaaccagcgacgagagcgcaagccggatgagggacaaggcatcatccgatccgacattgaatcgtgcaagaggtgtggactcgcgaagattgggcaggagccctgcaagcacgaggattatgcttcttgttagctcgaaaagctgctcaatgtcgtcggacagatgatcgtctcggccctcgctgcccttggcagaagggtggtctaaggacaggttccgtgctatttccacgatgacattctggatgggagttgtttcggtcaacgcgagacggtcaagagagtccatagtctccgagaaaatcgcatcctggtagatcgcattccccgagatgactggcctcaggatccttttaagagcctggagaatctccaatctctgggatggggttgttgactggtcaactagagcttcaaatgccagaccaaacagaacgaaaaagaatgcaacaggctcatcacgatagttgatgttgtcaccctttccctttggctcatcgttagttttctgctcgtcgtccttctcggtcttctccgattcttccaactccgacttgccgtccaatgcgtcaaagacaaaatcgatgtccttttcaaccaggccagcaatagcatcgacaaggtttaaccaggagtcttggtaaaactgtaacgatggttagcaccttgactagtaactttgaccctgccagtcttgtcctaccttcaagagggtctcccgattcaatgccgcgtacacctcgtccaagtccccgctcatagggccagtacccaagcttcctgagatatctggctcgaaacgcagccgagcatattcctggagcgaagacaaccatagcggagtgagtttcatgagatacggttgaaccacttggttcaggtagtcctgctcaacactggctatctgcagccgtgcccaggcagagtacaaagccatcttgaccatgaccctagcattcgggttaagacctttgaggtcgccaatctcggtagtgtcaaggttttctggggtggttagcggaattccattacaaacttttatggcactcactggagaagttttcaaggcctagaaccataagcttcaagattctgcccattcgatcaacgttggtcactatgccagtagcaatgaatgtcgcagagacattgatggcctctgatgccaattccgcagacgagtcagcggcaaacgcgggtgtaagagccgatccaatctgggcttgatactgttccagaagggatgcctcggtaaagtctgggtcgggtgtcttgccaaacatctgatagaattgttagctcagaaacgagacattttcaccttaaacaggggttaacgtactttgagaacttgatcaataatccgcagtccccagactcgaagttctattacattggcagtcgatgctgagaaagccatgcggacgatatctccaaccttctgctgcagcgcaagctcagcaggaatagtttgatccggcagaattgcctcttgcacaatcgccaaaagttcgctaagacagctcataacgaaattccgagtctgccatttcagaagctcctggccagagacagcgccatttgcctcttctgtctggccagcacccgcaattgcggacgcaaaccctgcaacctcatcatctggcatgtcatttccagtaggcctgattgcggatgttagaggaatatcctccactttaacacgagtcttggtcagcgtgttgtggcagcgctggatccacaattccgtctccacgagggccgtttgttgcagccaatcctggatcatgcttctgaggattgggcagtctggagtatcatcgaatgcaagccaaatttcctcttcaagagttggagtggcggtgcggaggacagctccagcgtcacgcttcatgaggttactcagtccccgaatagccacatccctcatcaacgggttgccgtcgctgagctcattctgtaaccgctttacatatccggagaaatcaacgtatcccggcgcatacagggagagatgatccaagcatttggagctttcagtgactagagccgagttgtcctccagctggaactggcgaagaagtgtgaggatgaggttgcgtgttttagcaatgtcctgaagatccggcccgagaacgttgatgagggagtcaacacagcgactgatcacaacaggagtgaggaaggacatttcgatgttggaagtcgctagggctgcagcctcctcattgtgtgtgtcagcgttgtatagctgggctagcattccgagggaacttgagacgaagggcgaaaaggtcagtccggcagagtttgctactctctctagaccaccaagagcccagaagtggacgacagggtgagggtcgctacacagggacatcaaaacaccaacaatggtctttaggtgcaggccagctgccataccaccaacttgggaatgaatgcaacccaaggcagcagcacagccagcacgggtattgggctcgcggttctccacaatggtgtcgaccagccagttgatctgtgtattggtgaaagcggtcccagagctctcacaaagacgtccgagtgcctcaaccccgattgtccgaacagtcagatcagcatcggttacgaatttctgcgtcaattagctttctgttatagccctttccatcatagctttgccaacaacaagccttacctggacaagttcctgcaacactttatcagtcgcgggattgagcttcccagatgtagaaccagtctctttcacggagaccttcagagcatggagtagtgccacagcgatattgacgaccatagcagccttgcgcccgggattacgctgaagactggtggatgagaggaaggttgcgatttgttctacactaccttcctggacccttggggtgtgcaacggaattgcaacagaaaagagctcaatggcagcattcacaacgccggtggaatggggatcagccaagggagaatcttcttcccttctcgagtataaaagcaaagaatcatgttcgcttgcttggcatatagggaaagtcaactgcagagatattagtcctactacgatttatctgagagaaaagtgggccactcacagcttcatccacagcttgatccgctgaatcaacagccgaccaagcaggaccattatcggtaccatgcttgccagtcagagtcacgcgcacgtattccctcgccaggcctgtcattccgaagccatagttatcacatagatcccacaaagtttcaaattgcgcggtggatgccgcgattgagctctccagtggaccagcttgggccgcgtcggggtctgcaaacgacgagatggccaggctcaataaactagactgagaaataacatcggcatggctaacagggtgaacccggagtaacttagaaaagcactgcagaacacggcgccggaccatggtctcgatatcatgaagttgcaatgatgggtgaagtcgttgcgaaagttcgttggcagtcttttggcggggcagatcgtccaggaattcaaccgtgttttggagcattacggcaattctcttcgcgccgtcggctgttataagtctgctgttgaactccataaacaccagcagcgaactcagagcgcactccctcacatgcgcaaggaagctcaattccagtataccgcgttttccagagttctcttgactcaggtgtttcgggagcgcattcttccatagcagcgataattgagagagatgaatcttcacaaaactagggccgagtggcatcagccctccgatcagaatccaagcgacttgaatctgtgtactggcggcacgcagttccgagttgctactagtcttcaggagatccgtcgcctgggtgaacacacgcgagaacacctcaactgaaccataaagaggctgcaatcgagatgtacttaacatagcagagagtccattggcataaccgatgcagcgacgcggcgactgcctaggcgttgacagctgtcccacttctcggttcaggctattcaagcaaatggtgacacaggacaacaactgatgcggacacgcaaggacgaagtttcgtaggcattgagctgtatggatctgaacagtatagctggggtgcggtaagacttggagcagagcttcgcgacaagtttccgccagggtaccaaaagcagacccaagggacacaatcaaagaagaaagtgcacttaaggcgctcgtgagggaatgcttgctcggctcgcggcgttcctggattacttgaggataatccttgagaacatcattgattagccacttggccgcattgagttgactagtttcccggagggattcgcggccaacagtatcctccagaatactcttgacgaacttcctggtcatcagaagcctgaatcgattgtacgtgacggtagggtggttgagaatatcgaaaagcagatgatttgcgatttggccataacgttcctcgatgatcttatccccaaggattcgcagaacatgcttgtagcagatagcgatacctgcgcgggcccggttggaagttgtgctccgtaaatactgcgcagacagctgacgaagaaggtcaggaaggaggaagaacaaacgcggctcagctttcttgggagcagatgattctgaaatttcggcctcttcttcatcctcgccaggtttagcagccggcttttttgatagtctctttgctttcttcgacttcgggactgagataattggggtatcggtagcatgcaacttggccagcgcacgagccaagcaggccgcggccgcgtgtctgaccggggccaccgggctgtcaatgactttccataccaaggtcttcagatggtcaaagtcgttcgtgttgtcaaagtatggagtcgtgttcactaactgctccaggcagcgacaggcatgtacttgaacgaacgtcgatttatccccggctgcggcattgcgagcttgtttccagatgtcgcgcgcagttgcttcgtccacggggactccagtaccgaccacgacctttcgcaggacggcaaaggttgacccacgacatccagtgtggttgcttgatgctttaagcaatttgagcaagcttgcaacaacaacgcctgattgcgcaaagacactttctccggcgaccgcaaagacctcgcccatacaatgggctacagcaaacctagtcttcaattccgcatcgctcttgcccgtatttaggaggcctagtagatcggtaacagttttaaatagtatgccacggtcacccttgctgaagattgccccgaaacaccggcctaaattattgcggattactcgcgtgatggtcggcgaggaaagcgtgagtatcttgaacaattcctttttcaagaacttttgctgcgccgatacttgagccttatcgaggccggaaatgtgttgaaccagatcggaggtgaaggtgaggaggtacaggtcctgttgttcggaggggagcgcatggagcttggtgatatcaagctccgctcgggggaccgcatggttgtcggagttggtagacgtagcgttttccgatgaagacattgggatcgactatggcgactaaaggctcacccatagggttccctttcacaaggaatgaacagaggtgagatgcgaaaggagaacacgatgcgaccgcaatctggttgacaggtcggccagactttctatgggatggggatgagatggatctcccccccctttaagcgggcacttggcctcacacctccgtccgggggcggtcgcggagaaactgttgcaccggccccgctatcagatcgcgattctagacgctttttcacgaagtgacgcgcttgcggggatcatctatcgaagctttctgcaatgacgacgatcgtatgcaaacgcctggtgcagcagcgggttgcccgcgcgaattgggtggtgggcgatggttgccgtaccctcaccaccagcgctccgtggcttgcaggacacaatcgatggtctcagatcaaacatgacaaggccaaaaatgacaaggcaaaaagcaaggagcgccaacttattggcaaggaaatcagcagtgcaactcagagtatgtacttggaaggctttcgacaatcaatcccccgtcattcttcggtattgatctcaagcagtgtggggtcccgatcctaaattcaatccgcgccttaccctcgccctttccaatgcaaagcgagcaggaattccaaagactgtgatcgaagcagcagttgctcggggacagggcataagtgtcactggtgaagctttggaacaggtcacggtcgaagctattctccctcattcggttgcggccgttctcgagtgtctgaccgatcagaaagcccgtgtattgcaagacgttcgacacgctatcaaagatgccgggggcatcgtcacacctaccacatacctctttgaaaagaaaggcaggatcatcttcgagaagaaggatggggtggatcccgacgactatatagaccaggctatcgaagcaggtgcgacggatatcacggcagatgagcaaggccggctccttgtcttcacagagcctacggaaacaaagagtgtgggcgagacacttgagaaaatgattggcctttccattgaggagttggatatcatatgggatcccaaccaagacacaatagtcgatctcaaggatgaggcacaggttgcggaaatggaggatatcatcagtgaccttcgagaagagccgagtctacgagatatctacctgaacacagtccagcgcttctgatgatttttcattgatttttggcagcttgatgccttccacgactacagcctggggcctctcatacttcctcattacagtgtacactagactcggaacaccttggagtggctggcggctcgtcgagccctttctgtattatattactacaaatcacgaaatatcaaagcgtgtacgcatttcgaatacatacgagaggaaggcataagtgagttttcttctgataccattctctactcttttcgcaaagccttcatcgtgctccgcattaaattaccaatcccaacacttccagtcgcgtcaagccagtcaagcatgcgcaccctatactcctgccacgtcatcttcatgcctccttctttctccagcgcactcagtgccttctgcgtcactggcttcctcagcttgggctgttcatcgctaatgttgttttcctcctcgaggtcagagaaacaggccgcagacatgttgcacaatgccacgtggtggcttagagagaaaaccgaggaaattgtgtagacaaaagaggaatcgcgctttctttccctctcattgaactcacgaatgaatcgcgtcagtgcaccaacggtgggggccggtatcaaacaacccacggcgttggggtcttccgagttgagtcctcggttccgccagatcagattacagatgtccataatatagccattgaattggcccacaagttctgtaggatagagcgagtcttgagagtttggtacccggagaacctgagaggtgagggaagcctcaaaggacgacttatagctggcaagtactgagcacatgatggagatgactgagttgatgggcgtgaaggcaagtgtatagaccgtaggagctagcgggacagtaagtcgaatgctcccattcagggatgcatgtgtgaaaagttcggccagggtacagtagaagtccaagatggacagtgtggcgggcttctgtgtctcatgtcgagcatctgtgggatccggcattgaggtcaagcactccaaagtcgataaagctaggagctctgcgtgcgatatcaggcgacccaatggcttgaattcctctgtggtccgggaatgtgtccttaactggattccccatcgacggatcaaggccgaatagaaatcgagtagagatgttcttgatgaaatggctccattaaggagtgctctctccagtggtatcaagaaatctttacctagaatatcgaagtcaagaatgggaatatacacgagaagcccaagtatctgctctttgttgtcctcaccattccaggagatgaggtactttttgagaaatgatgtgaaagcgtccggtatttcctataatagagtgagccactgaggtagcgaataatgactaacgggaaataccttcgtgtattgcgcatattcaaccgccaaagccaatatgtagcccaaactctcatggtcttccacgtcgtttgaccgcgcaatctccagttggtcatttaggaatgtttttagccagtcgttcaaccggcgatctgcagcctcagaacgagccaggaagaggtacttctgcgccaagctatttcccagcatggatataatctggttaggtaattctatcttgtcaatcttatcaacaagatgctcgacaccacgcagttcttccaaagaagtgtggctataggacactcttgatgtcttcacatcaggaacaatggcctctatcttgcttctttttgttaggccgcgatgtacaacctgaaatgtcgagggctgcactgcctgcaacctttcaaggtgcgtatcctgaatttctctgacatgagcggtccattcagggtccgggtgtttaaagaaggatgcctttcttcccgtaaaaccaaggtcaccgacaataacgtcaggacaataattcttgaacacattaagtagaatcaagagctctttctcttcaccaccggaaaggctgactaactccatgagagcttggatacgaaagggcttgacatgcttgcgcctcgtgatgaacgaaagcaagtggcacagaggcttgcgcagactgatcatgtccagatagttaaatagcacggcatatagttttgccagatgagccttgtcatcgaggtaatcgtatacaaggatcagccatcgcacaagcaaagcctgggtcgcaggactgggcttcgttttagcgggaccgagacagcacacaacccgtgtgattagtttggaaggtactctctccagtgggtacaagttcttgactagtgtagtgactgtgccttggtcaagagcattgtgtgtcgtgagaagcttcagcaagcgttcgagggcagcctgcggtatgccgctctcgtacgcgtgggttgctattgttttggccaactggccagcatccgtgtatcgctgttttggaggcacgaaagcaactggatacacattaatgatgcgccatttttcaagatgcctttagtaactggttttacctgcttcaagatgctcgatcgcatcttcaaggctactaggcctgacttcagtgtctagtatcactatcagcaaactcgaacctgtgcgaagaagcaagcttgacaaacctctttcagagtcggatgacatgcctgtttcgcaaacaaattatcaaatctatcagtcaactaatagaccttcctctcctctagccgagtgaggccgtgcttgattgtaggtgtttcgcaccaccaggcacatcacacgcaaaacaagactgtcgccctaagcaaacagcgcgttaggctctattaccataaagcgcctattattatgctctttgggcgcaaaagtgacagtgtgttgatggtcaagtcgtttttggccgtggtaggtgctttcaggatgtatctccgtcgcgtgggactgttcgagtcgatcgcgggaaatggaacctgagagagcaactttaccatttcgggtgtccaacaaccactgtaggccgtatgccagcgtcgccagttgtaactgcgaacaccatggatgctttgcagtaatcttgttctttttatctcatgtggtcttgtttctggtctgcatagacccaccaaaaaaaaaaatatgaatgttttttcaaggcactctagttgcagctacttatttatagatgaggtgcctacagtcaaacatcttcatatgcgccagactggatacttgccgtctcttcctcaaatggcgtattgagttactctacttcgcaccggacgatctcaatctagatggtcttgagctgtatgcagctcctcattatgcgattggtagtaatgacatcgtgggaggaacaaaaagccatggcccacaatgtctccaacatctcaactatgaacagtagtctgagaatacttccaggaagaatgaagccaatcacgtctacttcctctttctagccggctgcttagagcttgccttcccagaggcagtcgctgtctccttggccttgggcgcctcagccggtgtaggctcctcttcctcctcatcactgtcgccaccctgaccaaattcgttgacacgcttgtaatcaaccttgtacttccagccttggtagagccagatgaagaaaatgatatcatcacggaaggttgccaatctgtggagccaaggcatcttgacagtgaaagcaaaaaggtcgtcgatgaaggtgttgaggaacttgtacgtcaaagcctttccgggcatatgagcgacagactgcaatagcaagttagcaaaaattattacatggatggttaagaagggaacataccttcagtcgatagttgatgtacagactaggcaccatcatcaggaagccgtaggcgtagacacttccaacaagggtctcaatgacataggagtaccacgacttgtgcgtgttgtagatcaggctgtacacagcatatgcggccaagagcggaacagcaatgatatacagccagcggaatgcgatctcatcatattctttggtcttctgctccgtctcactgagcttgtgcttgtcctcaaagacaataacataagggaggaatgagaagaatgatccagctggcggaggacgcaagcgcacgtctactgtcttggtgatcttccaggcttctagcaggataccaaaaccttgacttgcgaggatcatccaagaagtgttctcactgttgtccatcaagtagaggaagatgaccgcctgcatgaagacattcgccaggatggtacgaacggaggtaccaacaacatccttcttcttgcgccagtgagactattcagagtacatacccattagcgtttgacacaagaaggattcgaaaggggaaatggagtgataagcttacaatatcgttcttgaaggccagagtttcgaagaccatatgcaggatagtaaccacaccagttgtgcagagcaggtagatgttcgtgtcaagcaggacttccttgaccatttcgaactcagtaccgtccccgccaccgggtgtctgaccaccaaaagccgcctgcttggcatttgccttcgcattctcatcaacacttgccatcatgctgaacttccagttctgcaggttgttgagagtgatacgcataggaacggtctcgacggtcgagttgagctccatcatgtgacttctgagctgccagaaggtgttgaggaacacaatcggatagtaccagccattctgcccagtggcatcccgcgcgccagtcgcttcgagctgcatatgctgtctaacagcagggtgaacctgccggtacttctgcgcaccggcgtcaggaacaacggacacggtgaagttcgggtggtagtaagacgcaatggagacatcgggagtgccatcatcttcttcctcctcggtttcctccgacgaagcaagcaggtttttcaacttcttcactttcttcttggggaggtactggttcaaggggcggaagaaatgaacggcactatcggtactgtaatccttagcggtagggtcgagctggtgtccggtgagtccgacaaagaaatgcgcccagagagttccattgcgttgaacctccttggggatcttgatggtcgtgtcaatttctctagtgtcactgtagtttccgatagtaaagttcttttcctccagaacgagggaatccgatgggaaggacttgaagccaggaacgacaattgaaggcgaaacgtagatattcaggtccagagcactatcggaaggccaaatcggggtaacgagatcgggaacggggctgtagttggacacttcgctgcgaggcggacgcgtgttgaaagaaggcacatcactaggctttgctcctgagcccgcattttgctttgacccaaagaactggctcatcacaaattgcgccaacaagaaaaaagccagaccctgaagggcacccttgaagccggactaaagcaaggaaaagcgactgtcagctaacccatcgaatcctgtaccacaaacaaagcagattgaagcatacgcacgccttgctccgactcctccctacgctgacgttgttccggcattgcgacccgtttataaagaacctggtcagcaaagagggaaaaacgggggagagggggaagaagaagaagaagaaggaagagaaaagaggccacgaaggaatacgaaggctaacggctggttggttggttggttctggcccagaagcccggcgtttggcccttggcgggtcccggcgataagccaggcggaagtgggaagcatgtcataaatccctcctccgcggatttctccacatcaccgatctgctacgattccgccggacttggagaagagcactgagtcgcgcaataggcatgttaggctcatgaaggtcggtttttatcccaatggcggacaatcagccctctcccgattactcccggcctcagtttcctgctcataatgagccgcgggtgtgggttatcacggccggggattcccccatcggcatctctgtgacgcgccagatcttaatgcatggagactatgccctggttggactggcgcactcgagcctagatcgcgatgaatgtcgtcgagatatgttcgatgcttttctggcagaaattgaaagcaatgagggatgggggaagcgattcaaggcactgcctctggacataaggtgtgattgggtcttgttactctcgaatatatgacataggcttataataatctcacagaatggtcggcgaatgtcaggccatggtggcgcaagctgtcgcttcattcggcagagtagacgttcttctttgctgtactagccaaggttagctttcaacggcctcgatacccacatcttgcacatcgctaaatggcatcgtagccctcatcggaacagtggaagagctctcagcctcgcagcagacactaaatctagtccgagatcaattcgagagtaactacttcggaccactcaatatcatcaaggcagcgctgccgcacatgcgaaggcaaaaggcagggcacatcacgatcctctccggcatcagtaagcacagctccttcttctcacatacatcaggcaaaatctaaccagagacagccgctcacataggtacacccggactgggaatgtactgcgcagccggatgggctctcgaaggcttctgcgatgtgagattcactaccacatttcccaccctctatcccaactttatcgctaaccaatccattaccagagtctcgcatatgagatcgctccattcaacatcaagctcaccattttccaatgcagcatcgagatcggcattctcacaaacttagtaaccagcgttccacccataggtcccgtatactcatccgctgctaaccacgcgccactcttccgcggaatcatgaaccgactcgtgtcacgtctgtcgagcaacacgcaatcctcagcgggttcatcaaatgggtcgaaccaaggtaactctatcgaagatggtccattctcggcctcagaggtcatatcaacgtatcctccgctaagttcggcgcatatggaggtgctggtgagtgagactgtctatgctattacagctattgcgggccatgagaatccaccgtcccgacatattgtggggcaggagggtgtggctagcgtaaaggagaagctcaagacggttagtgaagagctggaggacttcattcaggcaagctttgctgtggattatgctgctgatgaggctggtcggtcgtctaaggaggagggtatgattatgggtatgggtactggtcatgagggatttcaatgattattaagtcttgatgtgtttggatcaataataggtaatattgtgaatgagttcgctcatgcctatggtagaggtatcatgagcgacttgcactctattggcgacacaccgttatctaaagtagagtttatcgttatccaaactgggagaaattaaagcatgctagtatgttgggcgcacatagaaggaccagccatcctatttacttcctagcacgttggaaccaagcttgtctaacctcccatagactccccatatcctgattgttcctgtatgcacggaactctttccaagcattcccgttaggaatgtccgtaatacggccatcaacttcgataatcttggaggcaagcgaggtaagcccctggatattctcaaccaaaatcccgtccatcctctcatcgaggatgtccgcaggagccgtctcttctgtctcttttgtcgattcctggggggcatcaggcactgatacgggcggttcctctgatgcttcgcccgcactttccggcttctcacttgacgctgtggagattgctgcagcctcggcggatgaaacggcctccgccgccgttgaagggctgacggtatctgcggccgcttcggttggcaactcgctagaagatgccgcttggtcattggcttctggaggcttagaacgctgtcgtttgcagtcgccgtgttcatcttcacatttgcgcttcttaggagagacaggctctgtcgttccgctggcgttcaattggacgttatagtcgatttcagcagcattactatcttgctgctggtcgccagcttctacatcggcttttaacccatccgcatggctttgattttgtgtgtacccgcttgagacagctgggagaaatacacgctgtccgggaggaatgatgaagttcagccgcgcgccattaatgcccacaatctagcaagttgttagagtgttcatctaagtcgaatcgaggaagtgatgaaagttcccacataccctagcttccttctctaccagaactctgtcggcacctttggaaaagcatcgcgaatacttccagacatcgccctcgcggacaacattgtgatcgatcagtgtcttcaatttcacctgggagctttgccctgccaccaatgtcttgtccatcctctgtttctgtccccaaaactcctcgaactcttcctccttgaacctgtcaaacctgcccgcggccctctcctccatggccagcttggcctggcgcaaccattccggatcatggtaaccattctccagctctgcttggaattgccgaataccttcgcgccagttattcgagtagcgtaagaaagcgtgcggaattgggggtatcttcgcatcggggtcctcagatggcgggttagggtccggatgtacgccatccggaagaagtctgatgatctcttgcttttcgctctcttcgagacagtcccaagcttgagggttggcaagcagtccctactcaataggcatcagttagcatacaatccagacattgcgccagcgcgatagtgtcatatctagcgattccaacgtaccactaaatccgcatcaaccaagggggacgtcgtgctcgtcattaccctctgctcctcccatcgatctttcgcggctcttctaggattccgcttcgttttagcattggtagtagtagatggtgacatcgcggagctcgattcgccggcattactctgtttagccgcattcacagagcgagaggagcggcttctgaaacattctcaaggtcagcactcttcactaaatcagcgacggccttattcagcggtcgccatatgcgtcttgttccagccacaagagggaaagaagataacgcaagcattagttggctaatcgtaccttgttgttggctgcttcgctgctgaactgccgcggtcgaccgccttgcgagggcgggccattgatccgcgggcctggattggagatctggacaataccccgaagtcaccaacctaccactgcgtcgacagaaggagtgctcaagtaggtgataggacggaaattaagtatcgccacgatggttaggtcaacacagattgccagaattgatggtaagatgctgtccggagcttgttcagggggaacagagtgaggggtgagccaagtgtgccgtttactgatattacgagacaggcttgatgctggcggcatcggtggatgatgagcaggttagtttggttcagggcgcattcactgctctattgttgcttgataactgacaatgggattcctggtgttcttctctaggctgaagtggagctctctgagatcaagtctcaggctaagatgatctttcgccgattgaatcgcaattcggcgccgcaagccagtattgagtccggtcaatttaatctacagtatgtctgacattttggaatttgtacgacgcaaaaactagtcagtgcagttggctaaagaccggtgttagctatcttatcaaggatgatatctgcttcctttgcatatgcgatcactcctatccgcgcaagcttgcattcacctatctagccgatctcgcaaccgagttcactacgacgtattccccgacacagtatcaatctccgactctgcgcccatatgcctttgtggaattcgacactttcattcagcgcaccaaaaagctctaccaggatagccgcgcatcgcaaaatctcgaccgtctgaacgatgagctccgggacgtgacgaaagtgatgaccaagaacatcgaggaccttctatacagaggcgatagcttggagaggatgggcgaattgtcgggccgtctacgggaagacagcaagaagtacagaaaggccgcggtacggatcaactgggagttgttggtcaaacaggtaggttcaatgttgatgtgacggcagacttgacgctaacctgtcgcagtacggacctgtcgcaggtgttgggtttatcttccttttcctcatttggtggcgcttcttttaattgcgggcaaagcggctccgaaactcgatacccgctaatatgattgtatgcatagataatgtctctggtggttgcaggacaccatccccctaagcccaggacttaatcagctctaacaaaaatctggtagagctgttggagtgtatagcttaagccgtcgcatagttgtaagagcatgaacagcggctccgcatcatttgatcgcgcatggcccgtatcgcataaagatggtgctataaaggacgtcgcagtccgtcaagtggtgtcttgtggcgtatatgaaggggctgtctggtgatgaattcgaggtaaatagatctagatttcatcttcctcttcgtcaaaatcgtcctcttctcccatgtcgtataagatgcgtcctccttcaccaggaccgtcgccctgctgggcatcgaagtacggcagcaccacaccctctcgctctcgtctctgtctttccgtaaggcgcaattcgaatgttgattcgggctcttcttcgcctgcaccagcgtccggctcctgcggcgggcggtacaagggatggtcgtccagcaacgtcacaatctccttcacgtattggggagggtaacgagacgcaggaggaaggaagtaccattccaagacgccgcgaccactctttctgcggtgctccagctcgagtacaatcccctctgatgagtcttgaccactcggtctgtccagtcggccaaggagcacaccatcctgctcttcttcaagaccaaagacaggcgcggccaaactccgatcgcgtgccgctttctgcgcgagaatatgcgagaatgaatggagggtgatgattgtagtagcgaggtatgtcagcattgagaggggcgagggtgcgtagggcgagagagcaggtgggctgggaacatcctgatgaaagtttaccacgagcgacacctccaccttcggagctgtgggattcggtggaatcaggaaggagcttagaaattgtgatacatggaactgaggatcattctttttcgagtgtagaagcgggttgatggcgtcaatgaggatgagtctcccttggatacattagccaattcacggatgaagctcggcggaagaagcttgggataggcatacttcgggtagggctattcgatgagacattttggtaagcagcgccaactgctttcaggatctctaaaggactcttccggcgagcgggaatgaatgcatcgacgccctccgggggtttcaatgtttcaaaggcaaggagggttacatgggtcctggaaagctgttgcgacgacagttagccacgtcggcaagcaatgacggaacaggcacttaatggcacgagggccattgttcaactgcctcgtagccgactttcaactgtgcgaacagccctccaattctcagagcaaacagcatgcctacctttgcacgccgaatgtattctttggtcaatggggtcgcgggctgctctagtgagtccaagaccaaggtaagcggtgatgcggtatctctcaggctaagaagctttgaaatcaagagcagattatgcgtctgtcggtgagaagtgcttgcgggcgccataattgaagtcaagtaagggcgacgtgcagcggaggatcgggaatgggaaatttgaagaaaatcggaatcggttcggcacagaagattgcggggtccaggaatcgagctatggaggggttcgctcagctcggggcgcccaagatttccaatgagcgatctcgcttgcgtttaagctcatgctgtcggcccacccgcatgatgtactactattcggagaattaaagagttcaattgtcaggtgtatcacaagggatcattgcaatccatactgtctgaaagaagtagtatgtttgtaccagatcttcaacctgatacaatttgaggctcaaaagcactgtgactttattttgaggttaaaaagtaaacacatgccattatactgcaaatagcgcataaatcacaagtgataaagcagataacatctcttccatacccatagatgctattgtagtcactttcatgggctcattgaatatgacatttgtttatgcattgagatgatgggatctgtaccaatctactacacttgatcctgtgtagactacggagtaggctactaactagtactactgtgtgtgtgtcagatgccagtcaatcactagtcacaaaaattactgcaatggtaaattactactagtagttatcggaataaggccttatgaggcttttcccagggtctcaaactgaaaatatacttcgctggacggctgagctggctcgaatgggaacatgctgacagttgacatctgtctcagccaccagaaaggtaccataaaataacactaaaatttgaattaaactcttacgcgaggctgccaaactgagactctaccaacgaacaactggacctacatgggaatttggttatcgcatatctccggcaacgataaggtggccgcaccagttcccggaacaactcgattgtatgtcacaatttcgcttactcccaccttatgagtgtgaaattcgccagtctataatatatcatagcaatgaccgatgacagatgattcatttatccctctgcttatccagtgaatagcctgggtcgtagatcggcggtggttcaagcccatctggctagccgcgcagtaggtcgaaaccggctaccgtaataatcttcacgccttcaatctcgggacctgacttacggagcacttttctcattctcagtcaagactacaaccactacgtggcgcgcctatctctatcaattgacattgaaaagtagaggaagaagagtaatggactaattactttggatatctccttagcagccgccatatcccccatcccccttccctttgaaccgctcctgcggaatcacacgtgcacgaagaaaacaactctccatcaacacaacgactctcacagacaccgtctccaagatgacggaaccaccagcgaaacgtgctcgccgagtcgatagctcagctatgtgggaccaagatgaccggaggacacgttcacccgaattagaaccagattataccagaagccctcgacgggaccatgttgcgagagatgatggacgacgcgatgggcctcgtgatgatcggagataccgttctcgctccagggaccggagagacaggaggcgagatagaagccggtcgagggatcgccgcgaccgcgaccgcagagacagagacggacggggaatgagggatagggaaagaagtgtcagtcgggataggcactatgatagacgcggtatgtcggagataagaatcaaaactctttaaactacggatgctaacaacgcatgaaggctatccttcaaaaggagacaggtacaggtcgcgatcacctattccgaacggcaacagggaccggtcgcggacgccgccacctcgcggaccccggagcgaccgcaggcacgaccgcagggaccatagaggacagacaaacggtgctacggatgcgaagtcaggagggaaccggttcaaagacgaaatggaggtggacagtgacggagctgttggagaagacgatgtcgaggaaatgatgcgccgcagcatgggattcacgaaattcaggagcacgaagaataccaaggtccccgggaacgacatttacggagtccgcaaggagaagaagacggagtacagacagtacatgaatcgtgtcggaggattcaacagacctctcagtccctcgaggtaaccaaggccttctgtctcccggctaccttcacgatattatcggtcgcctcttgctcacatcctcaactttgcactttcgacttattccacacttctaaatgttctttctctgttggggcgatatcagttttcatgcatggctggagtcaagatctatggagggatttttcttttgttgtcgctcgacttttttcaagcaaataagatacctttcaaagcctgtctatacccttgcattggttcttagtagatcgaatcaaggcagatgtaatataattaagacttatcaggacgctcggcacatgacctcagtgacgtatgcccctcttttaaaaggcttgcttccgacaccaactcgactccccggcattacatcaagcccctcgtcatctcatcaccgtggcttctctgaaagctctggtgtctagaattgcgccataccacaagatgccgacctctggtgagcgccgtgaaattgtgatcgttggtacgtgtgcgccgcatgcgcatcaatctacttatctttatctaccccgcacagctcggaagatgcgtgctaatggctcttccttaaggtggtggtatcattggatgctgctcagcctattacttgaccagacatccttcttttgatccctcacggcattcggtgactctgatcgaagcatccgacattgcaggaggggcgtcgggcaaagcaggaggccttctggcattgtgggcttacccgagcaatatcgtcccactgagctacaagttgcatgcggacttggctaaagagcataatggcaaggagagatggggttatcgagaagtcaaatgtgggcagctcatggcgaagggccgtcctctcagtgacaagaaagataccggcgcaggagcaagcgggagctcggtgtcgctacagaagcggagcgccgatgctatggggaaattgaaagctgcaaagttccccaaagatctagactggtttgagcccgagtctgtgagaagctacacaagcatgagcgatcccggagagactgcacaggttcatccttatctctttacgacttctatcgctaagcttgccgaagagaagggcgcaaagattattctgggttcggttactggcatcgactattccggagatgctgtccagtcagtatcatataccgataagaagacggccgaatcgcgcagcatctcagcaacagacgttgttgttgctgccggtccttggacgaggtcggtcttgccagaagcccctatcacggcaactcgcgcacatagtgttgttatccggccagttgagccagtcagcgcatacactcttttcaccagcattgatctcccggccaacttcgatcctacgaagccttctcggcctgatgaggcagcgccagagatttacgctcgcccagacaacacggtctatgcatgtggtgaaggcgaccacgtcgttccacttccagaaaccagcgcagatgttgaagtggaccaagtgcgatgccaggacattatcaaccaagtcggcagcatctctgatcgactccgtgatggcgaggtcttagcccgacaggcttgttacttgcctaatgtggctgctgcacgcggaggtccattgattggccatactggcaccaaggggttataccttgctgctggtcatacttgctggggcatacagaacgcgccgggtactggcaagctgatcagcgaattcgttttcgatggtgcagctaagagcgcgaagatcagttctctggatccgaggaattttctatagaatagaaggctgtagatagcaatctgcacagcaaatgcataaattgcaggtagatttatagttctctctagcaggagcttattgcaggctgcaggacccattgtcgggaggtggagcttgggccacgtaatttgcggagcggaggccggccgctccagcagatgccagatagtaacaacgacgcgcatttcaatgaactgaaccgcatcggtctcaatttgtcccctccatgatcgtcctcagtctctgaggtttgaattgagttctggatgctttcgatatagaaaatgcatctttctaagatatccgcaatcttgacgccggtactcaatgccgctgcggtactctccagtcaagctccggccgatgatctctccgttctgagcagcgaggtagccagagccaacaaccagtctttgctatggggcccatataaaccaaacctctactttggcgttcgccctcgcatcccgaacagcctgtttgcaggattgatgtgggcgaaggtggacaattatgccacggcgcaacagagtatgtgtccggaacaagcagaccggtctcttccctccaacaattgtatccgcccaacttctgactgacggttttcaaaagactttagacatacctgcgagcaaaatgaaggcatggctggctatggctgggatgagtacgacatccggaagggtggccgccagacaatccatgatgccggaaactcccttgatctgacgatcgatttcgtgaaggtccccggtggacaacatggaggcagctgggctgctcgcgtgaagggtgttccgcgcggtgatgctgatcctgatcaacctacaagtgttcttttctatgcgggcttggagggacttggcaacctgggcgttgagggcgaacctgaggatcctcgcggctttacgggtgatgttaaactgggtggctttacgacggatctcggcgatttctcgatcgatgttacttctggccctgagagcaacgagtatccggagcacggtcacccaacatatgacgagaagcccctggaccgtaccttggtgtcgagtctgaccatgcacccagagcagctctggcagactaaaggttcggctccattgctggatattacaatctatccttcaggataatgacgctaacttcaagtgcagttatcatgtttacgcagatgaagaaagaggtcgacgaaatggtcgaaaagtatggatcagagaaccctccccctccctaccagctcttcaccatcaagaatgagcccggtgatggtaacatgcaccttgtgcagaaggttttcaagggctctttcgaggtatttcgcgcaaaatcaccccacctatgaaatgatacttaccattgctagttcgatattcttttctcttctgcatcttctccgcagcctatgacttgtgagatattttgccctcgacctagatacttaacctatactaaagaatgtgtcgatagctgagcttcttaccgagcagatctcaagcgcctctcttgagttctccgaacggttcgaaagcgttcaccccccgcaagcaccatttgatactgcggaatacaccgaattttccaagtccatgctctcgaaccttgtcggtggaattggattcttccacggaacagatatcgttgatcgttcggccgcaccggagtatgacgaggagaatgaaggcttctgggaagagactgccgaggctaggggtcgggcacagcccatccttgagggtccgaaggatctcttcacttgcgttccctctcgcccattcttccctagaggattcctctgggatgaaggtttccacctgattccagttatcgattgggatacagacctcgcgtaagtttccggaatccagagtctggcacagcattacttatagattgactaactccaacaagacttgagatcgtcaagagctggcttagtttaatggatgaggatggttggattgccagagagcaaattcttggatccgaggctcgcagcaaggttcctcccgagttcacgatccaataccctcattatgccaatcctccgacgcttttcatcattctggaggctttcatcgataagctggatgcgaagaagaacgcctcgatgcagacatacgctgattctggggtcactggcaacctccgctctattttcgtcgaccaacctgagttgggtgaagcatttatccgctcaatctacccgttgctcaagaagcattactactggtacagaagcacccagaaaggtgacatcaagtcctatgaccgtgaggcatactctactagggaagcctaccgctggcgtggacgctcgatccagcatatcctgacgtctggattggatgattatcctcggcctcaacctccccaccccggtgagctgcacgtcgaccttatgagctggatgggcatgatgactcgtgctcttcgtcgtattgcggtgaccattggggagacagaggacgctgaggtgttcaagacctacgaaaccgccatcgagagaaacatcgatgatcttcactgggatgacgacgctcgtacttactgcgatgcgactatcgatgaatatgaggagcatgtccacgtttgccacaagggttatatctccatcttccccttcctcactggcatgctgggcccggatagcccccgcttgaaggccattttggatttgataggtgacccggaggagctctggagcgactatggtattcgcagcttgagcaagaaggaccaattctacggcaccgctgagaactactggagaagccccatctgggttaacatcaactacttggtgcttaagaacctctacgtaagtagctatctgctctagacaagacccctcgcaataatgctgacctttcattttaggatattgcgatcgtttccggccctcacaaggaacaggctcgtgagctgtattccaacctgcgcaagaacttggttgagaatgtcttccaggagtggaagaagaccggatttgcctgggagcaatataaccccgaaaccggaagcggacagcggacccaacacttcaccggctggaccagtatggtggtgaagatgatgtccatgcccgatctgcccgccagcgagcagaagggccatgacgagctgtagccccatgtaggagaagtatgtatggcatagtttagatatcctggagtatcatcaaagtctgtacaatgttaaatcccgaacgccgagaatatcatgcaaatcaaggaatggcgactctaatttcagcgtcgtcgatgatggtcgggagaatccctttctctcgggtgagtgcgataacggtcctctcgctgcctcctatgatcatcacgtctccggtctctacttctcgaccgtgatcgcgagcgtcttcttctgtggtcgcgatcgcgatcatgatcacgatcacgcgacctacttctagatctgtggcgatgactgcgatgacgtcgctcgcgctcctcaccgtgcctgcgatgccggcgctctcgttctctgtccctgtccctatccctatctctgtcgcctgggcggtctcgctttcggtccctccccgggcttcgactacggccgctgcgtcgggacgagccatatccaatgccctttccttctttctcatcgccatcttctgtagcatcctgtattgtcctttgcccctctttgtcccctagaggcaccaagttggcattgtctgacgccttaggtggtataggaagacctaaagctcgtgccatcgcttcttcctcagcttccttgacgcgctgtttctcctcacgctcctttctggcctgatcttcgtcatcaccgtccccctttgcataccacattaaatcctttccctgttgccagcgtccgacaggggccatgaccgagtggccgagatagttctcgcggtgcgcggaatctttgacatcggaccatttgaaatcaccgcggccgccactggaggtgacagttagtttaggatatcatctcaccagggtaggtagaaagttggggaactgaccggctgccctctttccgaacacctgcgacgagatccattttgagggttaacccaacgggaagcagtggtttaaacacgtcggaaaagaatccaggatgaatcggggaagtgaagctgaagctcccggagaaccaccggtggcacgtgcgcagtcttgtgcctaaggcagccaggacgggctgaaagtgacctcatatcagcccggctgtgttgaggcagtccgatttgtgatggcatctacccggaggtgagattcctgagcaggaacttctagatcgctttactcttgtggtatgtaccttcgccagactcacgagttccgccgcagctttggacaacaaacccggccatcgttcgactccatgtgatgtcaccgagattgtattccctccagaactgcccctcgacgcctgtgtatgtcggtcatcttgccgccttcacttcccccgatccgtacgcctcgaacgtgagtggttgatcgtcggaaatatacttcggcgcactttgtccttgtatccaacccatatcctcccgttagcgactgccaggctgccaacatggcgttcagtagcgatgctggtaagctgccaaaagcgcggcctcgagaaggtctacagcttcggcctttgaatgtcgagaaagggtccaaaagagtatgtagctacccctcttctaccgtcatgaaagctactccagtgtgcaaatcgacttacaagcatgctgacctcccaccaagtactcttcgtatgtttctgctgccatgatccgaaacgctgtctgttagcgatgctgaacgaaactgcagcgcagatgatactttccctcctcagaccgccacttggaggaacaacttggtactttattgctgcctttcttgtgctacctgagtgccatgcgctaattttgctgaagatggcgctttcccagcgccgaaacttattgttcgtcgcttacagtcaccaaatctatgtctgggagccatcagggtcgtttcagacgctgggaaacaagcccgagatgataataacccccgtaatgaaggttccccatgctagcggctatattgcaccagcttcgccacacgcgatcaacaacctccttgtggatgatctaggtcgagatgaagtcctattacttgttactgattccggcaacgtttgtgggtatcgagtcgaggccatcttctctgccttgaagcgagcggcagagaataaggaagagcgccccctcgatggatcccaggtggatccattctttgtggaatttgttcaagctagtgcctggggcctggctatccataaattcgcccgcctcattgcagtgagcgcgaatacgggcctcataaccgtttttgcctttgcactcgtgaaccccacttcggaaagcagtagctcgagctatcacccagaagacgatgatgatatgatcgattacggccaaacctggctggaggtcaggaccaaggaccagttcaatcagctgcgacatctgatgccggacagacaccgcacacgaaatgttaagctgacttataccggtcattacgctaatatcccttccgttggtttcttgaattgcgatctcgaccctaacggcaattggatggtgagcacagacatcgataataggctccttgtatggcgggtatgggatagtcttggccctttcaacgtgaaccacttcaatgatgtctctttcaagttcttcccggagaccctacgtaacgagtacggttttatccccagcttgagcactaggactcgaacgactgaccaggtgatagtgaacgtggctggtctgtgattgccctcgacccgcggaccttccatcgtgttaagtctactgaagaagcttgtggcggcccacccaatcgccgggtaaagggcggccggaccgtttacgacctaacgagagcgaacagtcggataccgaacgcttcacagatatacaacttcttcccacctgcagtgaagatcgagtcagaggaacctgttttgcccgacatatttggagccgactgttgcattagcagacgaaacggcccatcccaggccgcttttggtgatggctcatcagcggcacttcgtcgcaatccaagcgatggcgcgtcggcagagtttcttgatgccaacgggtcgtccacgatcactggaaatgttcgtccttttgattttgctgatacgttcagccaccgagccgtcaatgggtctgtatatggcgacaacttgagccgcgacggctctgatgtggatgtgggagcgcataatgcagcaggtaatggccattgccagccactaaaccgtacagttcagagaattgacgctcttcatctaggccctggccccctgaccacaccagaattccttcaattcgcacttcttgaggctcttggcggcgaagcacccggtaccgaattttatgaggacgaaatagattattacctggctggaggcacttacagttccgatcatgagctggataatgccgacagtacttcctcctataatagcgacatgtcagcagcggggcctgtttcatacccactacttgacggtgagttggattaccctcaaagctctaccccctgtagacattgtcatgttgataacatttcggatacgaattcagcaggttcccgatttcccatcctacacttctcacaaacagacatccgtttaataccccatccattcgcaaattacgccacagtggtctgcggcgaccctttacgacaaccccttacccaccccattgtctccatccgagcctgcgatcgcttcaacatggtgaaatatgtcccagaacatggcatcgtgattgccgcctcccaaaaaggccgcgcagccgttatagccctcacggaatctgaagcaaccggcctatcattccgagtcgattggattgtaccgttcgagagtcaagaaaaatacggcgaccgtcctctcgtccccatcttgggaatgagcgtcagtcccatccaaggtttcgagatcccgccggacgtaccttatatcccccgcgacgtcaagcccgacgacctcgccttccaattcaagtacctgagtcatgacgaacccagctcctctctatcaagcagcgtcatgctacaacagagttccttcaatgaagagatcaacgattcggaagtcgatcccagtgaaactgccgatgacgacagcccccaaccacccccgctcagcttgccagaatgccacgcccgcgcaagcagtgcctaccagcccgaggaaagctggcgcggctggaacccatcgcgccattaccggctaatgctcatgtacgcggaccataccatcatgagttatgagttctggtacaagtggaatactacggatgccggtccgaatggccaggatctcgacgaggaagatgatatcctccttgtataggctcttcccctttgtgccacaaaaagcaaaattatgatagatttaggatagtggtgatgaaaagtactggggcgtgagcgtgagggtgcgagtcattgatcgcctcttcctcgcattgcatatatgaaaaagggcgtttttggagcgtattgttgttgtcactgaaactttttaagcacagcgctatgaccatggattccaaaccaagaagttcgttccaaggtgctagggtctctttctaagactgggttactcgatcgctcttatttctctctgttatttagtttctcttatttcgggatctgaggcccctcaccttttctatttccgtggtctcaatggacatacttttgactccgatatgtgttgtttatacggatgtatggtttactttaccctattttgtaatcgaaatgcaagatttcgatcgggaagaaaatggaaaagcgagtattaaatagacgttgctttctttttgaaacagaaaaacatatcatgatatacatgccaaagaagatcaacacggcttaaattgaattttggatgttggatgcagtgtgatgcaaagagaaaataaaaggaatatgtccaaaaccaatgaacattttcgctaatgcaagatgcatgcatagtcatagtcgtcaaggtcatagttagagatgaatggcaagcttcgcaaaacgtacatgagtcgtgtcgtgatacggtatatccatgaagaaacaagtatagataccaaaaaggggggtgaggtatggtaggaggttccaatatatttagatccgtggaagtgatggggccattgctagaaatcatcatctagctcgtcactgtcccattcgtcttcccggtcattcaggaccaggtccagaaacctctggagtcccgggcgtctgacttggggaggctcgccatctggacgacggcggacctcggccattgctcgtgcttgagcttgtctttcagctgcggctgctcgacctgcggcgtcgagatcattggcgttgttcccacgatggcgattacctccagctgcgccgttgttgactcttggagggaccggagcaggaggtggaggtcgtctgccgagttcccaagcaacgaggtcctcgtcatcgctgccatcgtcgaagtccagcagttcgtcgggtacacgatgcaaggctgcggctccatcgggattgatcccatcgccaccttccagatcccacagtcgattgaaacatccactgttgatgtcgttgaaatggcggtaagggttgtcttcgcagagccaactagagcagagatagcagaagtgggtgtcgcatttgaaacatatcatatgattgcaacccatttgcttctggcatggagcatcgcatgtcggacatgccgaggtgtacatacgcagatactcctccgttgctttctcctcggccgagagctctgcttcgcggcgagggaagcaccgtacgagttcgccatgccagcccttcttgcaaacacaacagaaggcatagttgcaatcttcgcagatggcgacgcgctcggacattggtggtagctgagcctcctcccctaagggatcgaacacgggtccctcttcatcttcgtcatcttcgtcatcgaggtcatctgtcattggatcaacaggcttggggtgtctcttggatcgtgcggctccttgacaccactgccgtgggcaatacacagtcgacttgtccgcctcgagcttcttcttccgtttcaggaaaacgtaacgctgcactgtctcttgttctaacgggatctgaagaagctcgctggggctcagggttcgatcttgctttttgtgtttcttcggacgggcgtcggtgggagaggtactgtttgattctttaccacaaccaggagccaaacacttgacaccttcgacgtcgccttccgttatacaagagttgtagaagtcttggagacaaggcacgcagaagatatgcccacaaagtacgagtcggtggcaaatcgtgcccttcttgggttcgagacagactccacactcaaaggtctcctcctcgaacctttcccgttcggctttgttgttgaagtctagcaatgcgatctttaactcacggggaagttgaacttcgccaccggatatgtcgccaaccccaaaagctgactccccaagttgctgaagatggtcaatatatgtgtataccacgaggtccttgccacattcctcccaaagacgttttccgtcatccaaaagacctgacaatatagaaggtggcaaccacggagggtttgtttcaagcctgaaaatgggcggttcttcggaagggtaaccttggggcagctcgatttcgaggcagatgggaggaagatgtgagagtgtatgactatcgcgattgaggctagcggagttatggtcacctgtcttgaaaggaaagccaggatcgttggcatcaaccgacgtgggaggagttagtacggcggggaactctgtctcggattgttgctggaagcagacacgcaggggagcagatggcttaaccggtagggtgagggatgctttgaatggcgaggacggatctatcttgatctcggggtagatggcagcaatggatgataactccaccgagcgctcatcttctggaagcgagtccaactctgtcatggtggacgcaagccgccgcagtgtaaggagtgaatgaatagccttgagatttcccagttgatcgacgcaaatagccagacgtgttgggtggcaaggaaggccttgcggcgaagcgaggccgaaacggtatggccgcagtataccccgggtagtgtcactgttccgatctctctattgtattcattcctctggggaggcaatcgaagtgaaaagagaggttaagggcggtgagggagaggtggttaagggcaaagaattaagaataactagtccatggatcagcatctagccagagggaatagttttatcaatcaggaagttcggtggcggagatccggagggagggtgcacctttcaggtacggccgatggttgcggaccaggcaatagtcatggaggcagtggagccgatagacgaacacaggaggggagaagggttgggcgagactgaaggagacaggaagcagcagtgtctattctagtagtggtttgtagtacagatatacaggaggtgaggcaatcagaacgaggctttggggggaagtgcgtcatgattttatgacccgagatagataagagaggattagcagcagcgcagcagcagcagtagttgaacaagatggaagaaggtggttgcaaacactaaagagctggctgggaccgaacaggagaagaagggaaagacatgtttgtgtgtgggaaaaaaagatgggatgggcatcaagcacgggatttgctgcccagtttggtcatcattttccaatgcgaaaatgatggaaaataaatgaaaatggaatgaaacgaaatgaaatgttctcgattgttcgttatttttttggtgactcgacagccttgtcagcctgaggccaaccccgatcttcccctccccctcattcctctcgccgcttttagttctgccatgttccccaaaggcggtgtcggggctgcgactctaaaagcggcgatgccaccatccgcagggactcgtgaccttctctcctgggaaggatgatgatatcgcctagactggtcacaatcagacgtctgccatcctaattttagaaagaatttcaacccgatcaacctgcaggaccatcctagaatcttaacatctgtctaccccgaatagatctcacacccgttatgtctgtgtgccagtcttgatcaggtttctgattcggtttagcccgttctgccagctggtattgtaattctgggtagcttctggttccttgtccacccaccatctgctagctcccagcaagactatataaagagaaacatcactcaatcattgtttttgaacttgaaccccgagttccacaaaatggctgatataccattggcatccttgtctttgactcatgtccactacgtaagtctttgccaatgctcctgaatagtcaaagtagcccggatctcaacgccggaccgtcgctgaccaagactatcaaacggaaataggaccccaatgatccaatttcctttctttctgcctggcttgccttagtgccacaagcgctatgcgtgagctatgctaccctgatctgggcttcaagagaagctgaggtagtcttgatgtttgcgggtcagatgggttgcgaagcactgaattttgtgctcaagcgcatcgtcaaagaggagaggccaaaacgtaggtatttctttgcagatgttttgctttccttcgacatgaaatggatggagctaacgactctctaaagaaatgctgggtaaaggctatggcatgccatcttctcatgcccagttcatggcctatctcgccgtctatgcatcactcttcctcatctaccgacacagcccgagcttatcgcaatcaggagcaaccctttacttctggacgcgagtattgatttccttggtgctgtgtctcggtgctggtgcagtagccgttagccgcatttacctgaattaccacacccccaagcaggtcctggccgggtgtggcgcaggtatgatctgtgcgttcgcttggttcttcatcaccgggctactcaggtcgcagggatggattgattgggttttgaacctggaggttgttcaattctttcgtgtgagagatttggttgtgaacgaagatctcgccgaggccggatggcaacgctgggaggccaagcaaaaactgaagcggaagggggccggaggtcaggcatcgtcgaaaaccgaatagtgcgattcgatgacattgaagcgcaagctcgtatacccgccgtcctctgtgatacccatagatttcactgcctatgattgataaatgcatgcaaggcctgggaagtgaaagtccctcggcttggttcgatcctggctggagttacagatttgcctactatgataggcttcatttatctacgagtatggggtaaacttggcgattagtccttccttaattgctttgttgaagatgaagggttttagtaatataaatgttggtggtaccgattggaacatgcagcttcgcctgaggatatatattgcaacaagacggggactagaactgccagcagtactagtactgtcggagtagtagtaagagtactaagtgcttgggaatgtgaccttggataaagctagaaagggttagagcaatagatcaacgtctggatctcctatgatcatgaaattggcttttaattgttttagaagatcttcttgagatttcccccttgatctccttgatctctactatggaaggaagatccacttcgaggggcgttcctcgcacgtgaccaccagctcccgcggatcgacggcttccccgaaactcctcgtgtggtcatcgtctattcacaaagacagcggagagagctgcctcagaaccgccataaaagacaccatgtgtccttttcttgagtaaataaccatgttggttgatctctgactttctctctcccaccacgctttgtcgattggattttaactttctcttttaacttcttccgggctcaccccctgttcacttccaattgataccctcgattttgtttctgaacatccttcataattttttttatgatcccttcatctctcgaattttattgtctcatatttacacaaacatggatgatgcatcggagcctgcggaaagtgccatgcaggagcatcatttcgtcaaagcagacgaagtcgaccagactggaacggatatcagtaccgtttctgatgaccagttgatggaggaggtagctgagggattacgtcaggagcagtcacagcagaacgtatctactgcgcctaatgaagcaccagtagagattcacagagcaccaaaacgcccggagctgcgtcgggatgctgctgccccaccaccccctctacagccaccgcctccagcaccggttcagcagaatgtggaaagaccatctgattcattgagtctcgctcagctaaagcagctggttcaggagatgcctaaagttgagcagcctgcgtatgctttcgagtatgccgactcccaaccattcgccgaggaagtcgaggaatggttccagtacagcgagttcgacagagtcatgctcattggcatgaagtcatcatttgagcatagatgggattatttctgcgaagaccagtctatggataatgtcccgcagtcctggattaccgcttcttatgaattacgaaagacctttatgaaccagcttattaataacttaggtgaccgtgcggttcttgtccgaattgaggccttggaggccatatgctatgctttgactggtgtctggggcctgacggccggtcgagttgtggatgagctcccggagggccgtcctcagccaggtgcagaggctcccgagagccggtcacttcagatcaaatcgattgaacagaatgtttccctgctccaagaatgctcgggtttccagccactgatgaactgcctgtgctgtgtctttgagaggcatcgcagttcaaccgcactggacgcggacagtgctgggcaagaaggcgccaaccctgcatatgttgctgctttggagagagaagcaaacctggtgttgacggctttctatttgtctgtggaggttggccgcacgcaagatgctcttgatccccagaatgcccctctaagagagactcttatgagtctggagccaaatttacttgtgtttctggtggagatcattgcgcggttgcgttgggacgactctgccaatgttccgctgaccagagtcattcttctgttttggaagtctttgcttcttttcttcggaggcagtaacaaattgaaggaggccaaggaagcactagagccgtccctcgaagcaaggaaaaacacctccaatagaaggacacctttcctcactgcctcacctctggattaccacacttttcgacaggagatcacgtccaagtatcctgcatataacccgccacctcccgtggtccccctagagctagaaaataattcgattcttccaccgctcccgcaacatcccagcaggatgagctcttctgcgggccccttctctggggttggcccttccgtggcgggtggtggtagtggttcaatcatccatcacccggttcacatcgctaccccagcaccctctcccccaccgtcacccattggaccaggcggaaaagcgggaaagaagcaaaactaccagacaaaccaaaactttcctttcatgtaccctcctctagacgattcgagtaacgaccttggaggcaagggcactacagagctgcaagataatcttgtggggaagaagtggcagggtagtgatgttccggcatccatcatcgaggctgggaggctgttctcaacacatgtcaagatgacaagggcaatgcgacaactgtgggaagagcgagagcgttttatgaaatacgaccgcggctggtatcctgatgaaagccagcctcttttgaacgagaacgccgttggtggactggcagatgagctgcaagatttgaatgtctccgagaagagaccgagtactgacagctcaccggaggaggaaacggacaatgcggacatccagcgacgcctggatgccgttgaatcgttctatgtgagtttgcgtggcgccctaggtgacggaacatttacttacggctcgcagagacaagcactagtgcatctacagtctataacgattgtctttctgaagataattctgacgaacgtcagcgccatggtgagccaggccaacggacaagctgcgcaggccatggggtatgtgatacacctgtaattgccattgtgtagcgtttactgatgcctcattcccagtgatggttatggatcggtgatcaatgggttcccagccaatcatgccaacgggcacattgatctcaattccgaggctgccatcgacgagctcgacaatatccggctccgggaaatcaccggcaaagcgatttctggctctctgctactgcttgtcaagtggttcaagagatctcgtaagctaccccggcctgaatgtgttggaaggaagtactgataagccctagatattctgaaattcgagtatataacgcagttgctactcgactccaactacctgcctttgattttgaagatgtttgcccaccaagatgtggaccaggcagtagcgcagaagaacgatcgcgaggaattggggtaggtgctctttcgtgatatagccgcttagatactgacgaaacaagatttttccgattctgccatctacactcgaaccagccgccggaatcgacaaccgacctggacgaagactcctcgcctagtgacgacgaggctgtccctccgcccatcacccgacatcgccaggacacaggcaattcagtacgcggcgtttcgcccgaagtacatgttcctgaatttatggaagggcctcatcgtcccgaagttgacgagctaggatatcctacagcacccccacctaaagagccgattaccgtgttctcattccgcaacttcttttcggcgatcaattacctccacatcatgcagaagatcactcgcgacaaagcccatcgatgccttctcctggtgcaatacaagtcgagcactatccttcgcaaggggcttaagattcccgacccccacctacggttctataccctcaagctcttcaaatcgcaggtgccatactgtggacgcaaatggcgccagagtaacatgcgggtgatcacggcgatctatctgtactgccgaccggagctccgcgacgactggctatctggcggagacattgactcggaggtggaagaagcgctgccactggaacaggcactgcgcggactgacgcactggtggcacctgcgccggtacaaggacgtgatgggaggcgaagaaggcgcatccatgatggaagaagagcgagatttcttcgtgcgggagctcgaggcaatgggatggggcatggcaggcgaggaatccttcggaggcagcgaggacgctgaaatgggcgggcctttgatgaacgggacggggaccgaatgggacggagctccactgcaaatggaaggatggtaatcctaccactacaagctacgaagttaggagacttggtacatacgatagatgttaacgctatgtaatgaatgaacaataccccaatggaaaacactctctttatacaatgccctgtattcctccctacctgatatcggaaaaccatcttagcattcgaaatgttttgaatggatggacggaccatccttatcgataagcaacccagtggaccccacgtgaccaatcactgcggcaactttttttctgcggcagaaatcatcaccttgacggccaagcagcacctccctcttcccttttctccccagcaaaaccaggttgaatcgtagcggggatacatcaatccaccgcgagaagtctttggcaagatgtcgtccgacgagattgtttggcaggttatcaaccagcaattctgcgcctataagctcaagtaagtttctatctcgatctctatccgcgcataaaaaaaatttccgcctaccacatacatacagcgcaacaagaaccgacaaagaagagagagaatataatccacaagtatataaataaaaagctaaccataatttgtttttgaaaagaaccactaagaaccaaaacttctgccgaaatgaatacaacgttagcggactctgcaaccggcaatcgtgcccgctcgccaactcgcggtatgccacgatccggtcggaccccgaaacaggcgcgatgtacctgtacatgaagacggtggaacgggcgcacatgcccagcaaatggtgggagcggatacgactgtcgtcgaactacgcgaaggcgctggagcagttggacgagcggctgatctactggccgaagttcctggtgcacaagtgcaagcagcgtctgacgcggctgacgcaggttgcgattcggatgaagaagttggctaaggaagatgagaggctgggtgagaaggtggtgacgaagttggcgccgaagattcggcggagagaggaggccagggaacgcaaggcagagagtgcggcgaagattgagagggcaattgagagggagctgattgagcggttgaggagtggtgcttacggagatcggccgttgaatgttgaggagggcatttggaagaaggtgttgcgtgggttggagaggagcggagagggtgagagggatgaggatctggatgatggggaggagattgagtttgaggatgaggaggaggaagaggagggtgttggtcaggttgagtatgttagtgatattgatgaggatgaagaggatttggaggatatcgaggattggattggtgaggggtctggcgactcgagtgacgattatgatgatgagagtgatgaggatgaggacagtgatgaggatgaggatgacagcaaccactctgatgaggaggcgaagaagcctgcgcctggcttcaagcggaagcgtcctgctccccagattaagccgaggaagaagggcccccgtgttgagatcgagtatgagactgagggtgctggcaaggagagcatcctggcttgaaggggatgagacattgaacataaaagcacgggtttctgttgatgttgctgctgctgctttcgtgtactgtatggcgttgtctggtttagatttgttttgtgtctgttattattattgctctgctgcgatcgggcatgtgcataccccgccattgcatatatgaatttattattcaccaatgttctggtctgcgatataagactatgtacatcgcaactacatggaggttataaactaggttacgaatgttgagacaagatccaccagttggctgtgtcagatggggaggaacaaaaaaccgactggagcagctcacgtgcagcggcgggatgaaacggagtggatcgccaacaagagccgtgaggtcaatcaatcaatcaatgtcaaacctcccctaaggggttgcaccaatacctcctgatcacccttctacacgctggtcggttcaagataccgtgttcaatagcaccttaattcctcaccgctgcagcttaatttctcggctcttgtttcgccccgcggaccagcatcagcctctcctcgtgtcctgacgccgaccccacctaagcaactcacctccttttgagcaaccccatcttcccttccacgccggactagccaaggggacctgcataaaacaaacaacaagaagaagacgaagaagaaggagaatcaccaaccatcatgttctcatccctgacctcatcctccgccatctcgaacctgggcacgcggctcacctccctccgccgagccatcaccctaggcgacgaagccgacgaccccgacaacgaagactgctctcacatttccaacgtgctgcgcgcctactacacggagaaaggacggcccttcccgggctggcttcccccggacccgaaagcgccaacgccagcgccggcacgggtcatcgcgacgacgcaagtgcaagccggagcagcggccggtggcggcccagcagcatcggcgtatggacgcagcggaggcggcggattgggagacctgtggggagattcgggttcagcgacggcgccggcctcgcagacggccagtctgcgtcgaggtcggttggcacccggcggcggtagtggtggaagtatgggggcgcctctagccgccacggccagcgcaccgtcggggatgattgcatcaccgcatagtccgtcaccaggtgcaggtgtgccgaccgggtcagcgagaccgctgcctagccagcgagccgggtcgtatcagacgatctcgggaccagtcacaggaggagggctagagcgagcggcgtcggctcaggagagactgcgagccagattacatgggggccggtctcccagtcccgggcagaatccgggcagttcgactagtcggccgggttcgccatatgttggagggggagcggatcctagcgcacgaaaaccggtaggcatgccgggaagacgataaatgatcgggcaggaaattttttttccttcgttttagtttcttacgtttaggctaatttactgtactccatcacctaccttgggctgggggtggtgtgcgtgtgtgggggggaaaacgaaggggcaaggagaaggaattagtggctgcaggggcttattgcaagatggggactgctggttagtgtctagtcttgtggtaactcggatggtgtccgcgggagggcaaaaaggcggcaaagtgggatgaagttgaagaaggagaagaggagataatgagaggaagaagagaagctaatctacctttgtgggttggaaatttccatggtttcgtcgtcatgagacgggggactctgtgtgttcctctctgtttctctggttgagccttcgtgtacctacctacctttatcctctcgagatgagagatcctaatatacaaacctagatcttgtattatcggcaagcttttccccttggtttgtaaaccatgtttccatcctcccgtgccgtcttggctgtccatcgaattgcttgttgcttgatggcattgcttgagtgaggtaagaaaaggctgggcgtaaacgttcttcccttggccaggaaggccttttttccggggggcatagaagtggggaacgcatccaggccatgcttttgactttttcttccttttacctctttgccctttcgcttcagcccggtgcgcgtgttgtcagtgtgtcacgcccagcaagaagttaaactagtgtcggagaggggggggggggcagcaggagggttcagcgaatgagggactcgggcttgtggagagtgaacggggaacggggaagggaagctttggggagggcaaaggaagaaatcggaggaagatagcgagaccagtcaagagattatggggaattctacgctaaggagatgcagtatggagtagcggaagagtcacggggccccgaaaagagaaagccagaacagaaaagaaaacaaaatggcgcaactaaaactaaactaccccacgaggctaaccggaataagcgtatcatggtatttttcaatgaaccatgactggtcagagtatcgccgagaatccaccggcttaggtaatgggagctgcccacggggaaatgtctcctccgcttctgttctggggaagaatcagcatcgcgacattcctttccattccactcattccactccatttctctcggttcgatgcgtaatggtcagacatcttttcggaggcttgattgctgcccatcatgcggttccccacttctgcatcttttccttttcttgtctccctcccccggctggccctcgcgtggtcggcttccttgactggttccacggcccgatactaacgagtcaaacccggtcctcatgatgggtccttctctttttttctgaatttttccttttttatcctctcctcttacgccgatgacgcttttggggaatgatgaggtagtactcagtctcagtcgtagttgtagctggacgaggaggaggcccatgggccgatatgtgtgccctttaaataccaccccccttctggcattccccagatacttctacctcttttctcttcttctttctgcgtgtgtctctatccccaccttatctctcttcctatacagaagatccttgccccggtcgtgggaggcatcttctctgtctctctatatctcaccctctctcacacccgcaaagagagtgaacaaaacctatactccttccccccctcctcccaccgattgtacctcccttgtacatatcataaaaatatccctttaatatcacaagcggctgtcacaccgcactttccatttccaatcatgggtgtcgtacacgacctggacacctcccatgatgaccacaaggagggaaccgccttggagatggacgatgtcctcaaggaccccaaggccatcgaggaattcaacgaagctgccatggatgcagagttgttgcaactcgaagagcagctgcaggagaggaagcccggttggttcgtgggcttctccaatccatctgtgtatacctacgtcctagtggcctttgcctccatgggtggtctgctctccggtctggatcagtccctcatcagtggtgccaacatctacctgcccgatgcattgaaccttaccgacaaccaaagtagtcttgtggatgctggtatgcctctgggtgccgtggccggtgccctgatcctctcccccgccaacgagtacctcggtcgtcgcatggccatcatcgtctcctgcatcctgtatactatcggtgccgccttggaggccggtgccatcagcttcggtatgatctttgctggacgtttcgtgcttggtatgggtgtgggtctggaaggtggtacagtccctgtgtatgtcgccgagtctggtatgtacttttaccccttacttccttttacatcatcatcaacgtccaatgtatcgactaacgtcacttcagtgccccgcaagatgcgtggtaacctcgtctcactataccagttgaacatcgctctcggtgaagtcctgggctatgccgtggccgccatcttcctcgatgtcaagggtaactggcgttacatcctgggatcttccctggtgttctcgaccattctgctagtgggtatgcttttcctgccggagagtccgcgttacctcatgcacaagggccgggccgtggaagcctacggcgtatggaagcgaatccgcggcttcaacgactatgacgccaaggacgagttcctgggcatgcgccaggcggtggatgccgagcgcgaagaacaagccgctaccaagaagtacgcctggatggacttcatcacagtgccgcgcgcccgtcgcgccatggtctacgccaacatcatggtcttcctgggccaattcaccggtgtcaacgccatcatgtactacatgagcacactgatggatgccatcggcttcgacgagcgtgacagcgtcttcatgtctttggttggtggtggctccctcctgatcggcaccatcccggcggtgctgtacatggaacggttcggccgccgctactgggccaatgcgatgctccccgggtttttcatcggcttagtgctggtgggcatcggctaccagatcaactaccagacccaccccaaagccgcccagggcgtctacctcaccggcatcatcctctaccaggccttcttcggctcctacgcgtgtctcacctgggtcgtgcccgccgaagtcttccccacttatttgcgcagttacggcatgaccaccgccgacgccaacctcttcctctgctccttcatcgtcacctacaacttcacccgcatgatgaaggccatgacccggatcggtctgactctgggtttctatggtggaattgccttcattggctggttctaccagatcattttcatgcctgagaccaagaacaagtccctcgaggaaatcgatgagcttttctcccgtcccacttctgctattgtcaaggagaatctgaagagtacgggcgaggtcattgatgatttgttccacttgcgcttcaagaaggtgttttcgccgccgccgaaggaggactgattgactgattgattgattcatgggttgggagtattttgacccatgtatcgtttttggtcaatgtggatgatgtatatgtttatgaatataggatgatctgaagatgaaacaagaagaaaaacagaaaaaagaaacgaaaaattgggtatctccccgccttttttgatttacttacgggtttatgaggactctatatgctctatttaatgtctgatgtaactacctacttactaccatttgctttttcaacgtcaataatacccatacccattctgccacatacatctacatctacctgcagtatttacctactacatactatatgcatattctgtgttcattgctaatactaaatgtaattatttttgcagctacgagcttaaaggggagacataacgaatcaacatccagcctcccaacttaattcaaggtcttgaactcaatttggcacgtggcttgaaaccaaaccaactcggcacttatacgaactataagatacttaagttatccaccctgcttgattcccagtcaggaattattactgtaatataaaataatcaaaaagcatataattcacaacgctaagtctatataccgtgcacgcaatggataacaagcaagacgagcgagtaagtaacaaaccagtttttggttcggtgatatacaaggtgtatagcatatgcttgatggagaaaaagcaaagagacgaaatatcatgatgagtgaagggcaagaaggataccaccaatagcggtttcaccctcctcaagcaagataggtacgacatgcataagatgaagaacagctacccccgcaccttccgataactgggcggactccacgaccgcaggatcaatttacctgcccagatcggaatgagggagacggcgcagacggcacagacgcgccacagccagtctaccgtgatgacgtagtgcaggtcaaagtagctgcccaggaagggaacgctagcggcgtagacgagagccgtgccgatgatgcagaagatcatgatcgggtgccaggtggtgatggcgatggcgaccatgaggagctcgttgatgacaagggaggtgaaggagacgctgatgagacgggggccggtgatggtgtcgaggaggatttgagaaaggccctggattacggcgccttggtagacggagaccaggacccaggtgaagaaggagcggtagctgaggctgcggccggttttgagctccttgtaaagttcggggtagaggtttgcgagttcttcgtcgacgtcacggtcgaagacgagcgagaagacgggggcgttggtgtagacggtggcgtagccgaccatcagccagttgatgaagagacccttggggtcaaagtggctggcgatgctgtacatggtctggcaggcgctgatgatgagaccacggtgcatgatgaattgggcgagtttggcggatcttttgtaggagttgcggccgtgccagacgaggagtttggtgagatggtggaattgtgtgatgctaaagtcggctgccagggaggcttgacgaccctccttaccgacaatgccgattccgacatcagcggcttggatcatggagacgtcgtttccaccgtcgccgatacagcagacacgctttttggtgtgctggcggatgagatccgctacttcggccttttgagttggcgagcaccgacaggcaacaaccgcagggagcaggacggcgacggagatgaacgctgtccggaactgacctagcataagggaaagagactcgccgtcaatgaggagacagcagtcggtcttgttgcgaaggaaatccaaggtttcctgagcggtagacttgtctttgactttggcaaccgtatggatgtactgcccacgggcgaccagctttgcggaaatggctacacagcgtgctgtctcgaccttgtcacccgtcaacatccaaattttgacaccagcgttgcgaagcagctccagagagggcttgacatcccgctggaggcggtcttccacaccggtgacgccgagaagttcaaggtctcgctccaggtactcgctgatcaccttggccatgccgacatcgcgtccttgcagagcgagagaggcttgcttgtacttggtggtgaactcttcgtattgctgcggcgatagccgccgtcggcctacgactagagttcgtaagccctcgcgagccatgttagcggtctcctcatcgagccaatcgttcgccgcaacaattgttgtcatgacagtatctgcacccttttggtagaaccatatttcactgtcattcttggacgagtccagtatatcgtcatccgtctcaaactgcacgataatacccatccgcttactgtctgaagtgaaggggaaaatctcaagaatgcggacccgaacgacaaccttccctgtgtgtgtagactcaagaactatagactgtctgtcgcgataagccaatttgagcccgacgtcttcggtgtatttgacaatcgcaatttcatctggggaggaagcctggtaattggtaactctgacaccgtcctcttcatccgtcgtaggggtgacattgtgacaaagggcaagggccagaatgatgtctctgacacgggagccaatctcccttctcgtgcgcggagccgtcccaagtccagcttgggctccaaatgcggttgaaggagtagtcagcgattcaccaacgaaactttgtcggatataggacgccacttcttccatagcatcgttggcatacgagaccgtcccaacatggatcttcttcagttccatctctgcttagattagctaacgaacagagtcattggtctatcggagaaactcaccgttttgggtcagagtccctgtcttgtcggaaaggagatactcaattctacccagatcttcaggaatagtactggtcctgactactgtacccggtatatccttgtctcgttcgatgaaccgcccgtataccgatttcgccatgtccaagttgacccgcagactcatggggatgatcgtagagaagagaatcaagtagatcatgattgcaacataccacaccttgtcatttgtcggttggaagccttctagagcaaccaaaacgatggacaaggccagggtcagagcgcaaaggatcttggttaggttgttgatctcgtactccagcaagccaactttcgagcgagacggtgaggttgaaagagcagcccgcgtctgggatcctgtatagatgatggtagcgtatgtgacggtgttggaggcaagaacagtgttggcccatgcggtgttgtcgatcgttaacggagcagaggtggcctgggtgtccgaggtttcatagtctccgccagtttcccttttgtcgacatgaggatcataaaacccggaaggtgggcccagatcgatagtaccgacaaattcattgactcgtctgtcgggtgcacttgcagtgaccttcaaccttggaaggtcgctaagaggcagggtttgcgacaatacagagggcaaccgtagcttccagtcagtttcaccatccaactgatcagtccgtatgaatgtgtcactggccgacgagacattagcttcgtttgtcgcagtgctcgagctaggttccggggtggtaggtgatagtaagctttcttcttgcgaagggacctccaccggtctttccgccaaggagctttgacgagctgtcacaatgtcgtttgagatgctctttaaaatcacaacatctgcaggcaaccgttgattcttgcgaaccttcagaacgtcaccaactctcagatcccgtgacttcttgacgacctctagcaccccgttaggcccatcgaaacttagaacagtgaattcctcagcatttgcctcagcatctctgcgacggcggccaatgtcatccagcgcctccttcccaagtgatatactaacaacaaaggccaaaggcgcaatgtaagatgacatataacctattcggagaaccggaatgatctgtgaaagggcgacgaggagaaagtagatgttgaagaagaaggaaaattcgttatacagagtgcggggcaagaagctccagggggtgtactttgcgttcgatacgacattcgcgggatacttggttcgttgcgtctggccgacgaggacatcgcgcggcggcttcgtctcggtctgttctgaatcggatcctgttgtacggctagaggagccaaagagaaagctggccgccttgatccccgggatcctaaaccgcgagcccctttgcgacacccgttcaagatccactaacgagcgagcggagctacgccggcgttcattgaggagaggagcatcgtcgtcggtgaagttgcgggagctcgcgtgcgacctgcggagtccctcctcctccccttcctccagcaggcccgccgtgtcctccgatggtccatgtgctccggaagcgtttcgtcgccatactcgatttcccatgccaacccgtaaattccgcaaagctatgccgggaccgcgactccgttggcgattcgattcatctcgagagcggcgagaagatccatataagtgggtgctgctcggatcaagttcctccaaatcgaggtcgtcgtcggaaccagagtcgcccgcgatactggcacgaccgtgtggatggaggtagtcggacgaagaaggcatggtaaagacagtcggaaaggagtcaaagaggttgtatcatgtacaaggagcgatacggaggctcctgtgttgacaagaaagtgtcatgtcacgccgagcggtaaccaatgtgtctccgaggcaccattgctcggtatagctggctgggaggcgggcgtatgcagtcggaacttgtatgcgcgtgaatgggagatacctatggatggcgatgagggtaggtgggcaaagcgagttggtgtaaagtcagctcagtgtacatcccccaaaggttcgagtccaccacgtcagtctgaaccattcgaggaacaagagaataacggggataatcttggtggcctaaagcggttgcgatggcaggcggagacagagcgggatcacatgatgtaaagagccaccaaaggagagggcggttgtggcgcagtgaccaactggtcaattagaccgtataattagtttaagttatctgaaacggcgatgtcatcagcggagtcaatggcaacataatcatacactgtagatagaatagataatggttattgatggcattggtttcctattcacccagcatcatgcacgggctttcatcctgtgtcccaaggagttctcatcaggaatgtccgaactacttgtatgcctactcaaattggtaaaagagttgtagaacatgcagcaacagtctcccttatcctctctattcaacccattgagctccatctcggatcgggggcgattcaccacgtgacccagcgcaggaagaggtaaggtggcacttccgcccccgggacaaccaatcttccagccccgggatgacgggcgcgtcccaaagccgggcaggtcattattattattattattaactagccagtcagccagcacagccggtgtgcagcagcatcataagcccgcagcccaggcactgcagcaccttgtctggctttttccaagaaagaaaagacaactttccggagatgcagtcatgattttatactccacttacttcttgtaatgctttgttattggacccggtcttctgtgtccttcttattctattttatgtttcagtaaatcaccgattctagcatctacggtttatctccccgtcgggtttccgggtgagtgcatctgcaaacgtgtcctatatgccgcctgggtctgacgattgcttcccagtgaaaacccccagcttttggcaagtatggcgcagagtgacgtggcagccgtatggaatccggcgctcagatcagacgacaatgctacccccgttccgactggcccggcaagtttggagatcgatacgtcgatagaggccaccaccatccccctcggctcgcctatggagacacctcatgaatattcaatcagcgacatcgctttcccggattccgacactgctgccccgccgcaagaagcagctagcccggatatgattgacaccgagcctttgccaaaccccgatcaaataccagctcgcgatgaagtgcttgaagctccctcggctgatgtcgaggcgacaccggagataagctacgaccacgagaccccgaatctggatgcaccgcagacggaacatgcccatgacaatgaggctatgcctctggatgatcctgaggaccaggtaacggaagcccagcctgctcagcctcaagccgaggattctatttcgactgaagctaccgccgcgcaagatatggatgtggaggaacaaagtagtacacctcacgccggcgaccaggatgggaccgaacctgcagataccaatggcgaggcccacagcagtcatgacatctggggaagtcctgccaaggagaactctgcggaggatgatttcttcaaccagttgaaaacacagactaagcccatctatgtacctccggagaatgaatctcgcttcgaagagggcgtcccgttgctggatgatagcgccgaatcaccagttgagccgactgccacacaggaaggtcagatcgataacctttttaccgacgacaatgacgaagatgatggctttttcaaggctgtccagagttctccgcctccggacaaatctcaaccagcgtcgcatatcacgcgcaagagcacctttcaagtcatggactccctcggtttttccctggactctccgatgagcgatgcggatcctgctgcgcaagagtttgataatgctctcgctgccgcgacaactaataacagtgttggcatatcggcctttgaagaggacccggctgcgcaggaattcgataatgttttagctgccgcggcaacggacaacagtgctgataagccatcttctgaggaggatcctgctgcgcaagagcttgataacgttctcgctgctgcgacaaccaataacagtgttggcatatcggcttttgaagaggacccggctgcgcaggagttcgataatgttctagctgctgcggcaacggataacaccgttagaaagtcatcttctgaagaggatctggctgcacggtggcaggctgagcttgctgaagaagaggcagaagttgctccctccgaagacgacttggctgcgcggtggcagatggaactcgatgatgacgacgacctacttctagaggatgatattggaggagctacggctgaacacgcaccgaccagccaaaatatcaacggggccactgccggcgctgctgtcccgggattgagtagtcctttcgggactccacagtcttccgtcagacccggtgcaccagcaactgcttatacgccgcatcagccgtctacgtcggacttgcttcaaggggtccctgtgcctggtgcagcgcctccggcaaacatggccgcctctgcagactactttacgcaaccgccgcgaccaaatgttactgcaaacaaagcagaaagcttcgccgaacgggcaaaagaaggctacaggtcaccatatgatctcccggaggatcttacacgacctcgacggcctgtggctagtcataagccagtggttacacagcccggtagtactccacctcccccgcgaagcaatagcattccaattcctccgccgtcaacttccatgccgccacctcctttgggggcacagccggatggagcgcagtcgaccgccaaggtggccgctccgaagaacttctatgaagagctccctctaccccctcctcggccacagtctcggccagctagctcggggcggtatactcctggtgctaacgcaatgccccccgcgtcatctcatccgcctcccccgccggccaatccatatgctagcctttccactgctcccccggcagcggctgaggcttattctcagcctcaagttcagcagcccgaggggctagatccgtatgcaagcctgtccgcacctggtgcctcaagcggcccagctcctcctagtgctacttcgaggtactcaccgaagccacctactctgcaagccggaattaagcctccgccatcgcctagatattccccggcgcctcccccggcgaccgctcccccgccacgcaatcgctatgcttctcaaccaactgctccaccctcgcagggagttgcacttccattccagcctcgcacgtcaagccctctggcttaccatgaaaaggtctcttatcgtcctcaagagccttcagaacaacaaccttccgctatggaacagccagctatcattcctccaattgaggtgcaatcgcagccgactgcccctgctgagtattctcccattcagccgcctgaagtcccgcatgttccggaagctgtcaacatggggtccagcgtgcatcaaatgtcgcagcagccgatgtcgcctcctaggaatcagtatgctcctccgggttatgttgacgaattttccaaacgcatcgcccctattgccaacgttccaccggcgcctgtgctcccagcagatgatccgacattcgttcctccgcgcaggtcaatgacacaatccccaagtcagcaaacgcttgggccgaggttgtccgtgccatccgtggatcccctacagcggcctgcatctgttcacggggcggggtctcccaccaaggctgtgaacccttacgcaccagctcagatgtctgcgcataaccgcgtcgcctctcagtctttggaatttatccctcctaccgatgatcaacagttcgatccccttgagcgctggaagggagctcctattgtcaaatttggattcggtggctcagttctttcctgcttccctaagcacattcctcgatactctgccggccaagctactccgaagatcaagtctactcctggagaggttaagacgcatcaactcagtgactggattcctgtgcccgataccattgcgcgccatccggggccactaaaatccaagtccaagaagaaggatctgcttgcttggctttctagcaagatcgctgcgtttgaaaatgagggtattccccaggctgtctacatgcatgcggactctcagaagcgaagcgaagaaaagatactgttgtggaaggtcgttcgagttttggttgaacatgacggtgttctggaagggtcgcctgaaatccagaagtccctacgccaaatcatcttcccgcatttgcaggatgttgactccgcacagccctatggtaatggcttgccatccttcagcacggctcagtcgttggatgctccttctcgtcccgatgccgctgatcctcaagcggtcgagagtattcgcaacaaccttctggtaggtgagcgtgaaaaagccgtttggggcgcggttgaccatcgtctttgggggcatgctatgataatagcgtcaacaatggacaaatctgtgtggaaacaggttgtccaggaattcgtaagacgcgaagtgagatctgcctcgggcaacacagaatcacttgcagcgctttatgagatttttgccggcaatgtcgaagagagcgttgacgagcttgtgcccccctctgcccgagctggattgcagatggtcagcaaagttgatggacacggaacatctaagaatgcgctcgatggcctcgacagctggagagataccctgggtctggtgttgagcaaccgcagctctgaagactatcaggcgctattagctcttggcaggctcttacagtcttatggcagaacagaggctgcgcatatttgcttcatcttttccagagctgctgtgttcggcggggtagatgacccgcaggcaagcgtagtcctccttggtgctgatcatcagcacttgtctcttgctgctctgcaggatgaggattctattcttctgaccgaagcttatgagtacgctacctctgttctttcggcttctcccaagccgccgcttccccatctgctggcattcaagttggtgtacgcgtggtctttggcggatcaaggccgcaaatcggaagctcagcagtattgtgatgcgattgcagctaccctgaaggcaaccaccaagccatcgccctatcaacatcagcacctgtatttcggtgttgacgagctttcggcacgtctcagacaaacaacaagcgacggaggctcatcctggatatccagacccagcatggagaaggtgtctggctcaatgtgggccaagttcaacagttttgttgccggtgaggacaacgaagctggatctgccggttcagcaaaggctggcgatggagacatcggcccctttgccaagatcgcgggaactcctactgttagtcgctcaccctcagtgtcggatatctacgggtcgtactctgcacagccgagctacagcagtggcccgtcacgttaccagccaaataaccagtatgctccaacatcttcacctgagcagttgcgtggcagatcgtccctcgactctcaaaggtcttcttcctatgggtttggttttggccaacgacggggctcgcaagaaccttcaaccccggttgagagcaatatgtatcaaggaggaatgctatacaactccccacccgctgttggctatcagtcgactcctcctcaaacgtcttacatgcctcttgcaccagtcaaagaagacctggctcctcaagctcatgccgaagcctcggctggtcctgtagaacagtcttacggcagcggatctccgtatcagcccgcaggttatggttcttttgatcagcctttcatgaaccaggttccttcagacggggctggctacatgcctcccggtgtgagcagtggttatgagcctcctgccatcgaaagccacccagaacctgtagcggcaccatcggaagaagtcaacgaagaagagccagcgaagaagaaatcctttatggacgatgacgacgatgatgatatagccgcgcgtgccgcagccatccagaaggctgaaagggcacgcaaggaccgcgaagcggatgaagctttcagaaaggcagcagaagcggatggtgagtactcgtcaacttgtcccaagaatatggaaatcatactaacatgattgattgtagcccaaaaacctgcaccggctaagaagtcttggttcggaggctggttcggaggtgctgctggtggcaagaaggaagacctgaaccccaacaagcctatccgagccaagcttggcgaggagaactcattctactacgacaaggatctgaagaaatgggtaaacaagaaggaccccaacagtgctaccgccgcacgcgccacgccgccgccgccgcgtgcttcgggaccccctagcagaacggccagcggtagcagtgcagcaccaccacctccggcaagtgcatccccaatgatgccacccccgagtagccggccgccttctaccacaggaatgcctcctccgggtagtccagctccatcatccctgggtgtgcccccgccttcaatccagcggtcagtctctactggtgccgctgtctccacgcccccaagcggattggcagctcccccgaggccagcaacttccttgagcaatgccagctccatcgatgacttgctgggagcaccaacggctcgcaaaggcgccgcagccaaaggaaagaagaaggggcgctatgttgacgtaatggcaaaataatccatccatccatctcaccttgccatgcccaagaacactgcggccattacttccggacccagtgttgggtttaatctttatcacctcgctattccgataatgtctaacgaatctcctcctcgattcaccatttgcatttgacactttatgaagcgcgtcctggcttttgcctggtttagacccccaaaagtcttgcatgctgtcttctccgagagcaagacggcttctttcgggcgttgtttgcatgaaccaaccctcttcttattgttacttgtatgttgtatttgtgcatatatgttttattcgcttattattcttatgtttttcttttcttttcctttgttctctctgacgatgcggattatggagatggacgaacttgatgtcggaggtatcatgatgcctcgtggcaagtgtactatatggctcttgtgcatgattaattaatacgatgcttaactaatttatatatttgtggtagtcatagtagataagcacctcaacccctaggtaactttttatatccgtatttcatatatgcatcccagaacaagtagtgttcctataccagctcatcatcgtaaacccatcatcattctatgatatgctatgtgcgctgtgccctcaactaaaccgcataagaagtgatataatactgcacaacaaccagtcagccccacctcgcccttctcccacacagcaaactataagaaaagtgtgactcaccgtcagacatgaatcctgctcattccaactcccaggtaagaagacatacagcaccaaagccgtctcatgaataaacgctatccccaagccatcattagccctaaaatcctagagaaagaaattggaaaagaaagagagaaaggaacttacaagcaacaaccctcggattcaacctgccgacactcaaaatccgactccaatccttcccatcaatcctgaccttcgcccacccagcctcatcatccgccggcacctccctcatcctctcactcggcaactgattcaactctctcccatcgcccagctgccccggatccagactcggattcagtagatccgtccagacgctcgatatccggaatgcgtccgtcccgacggctactttgagggagccgtgcatgttagcggagagttcaagcttgggtgatgatagtgatggtgttgttgaagtagatccccctactgctgctgttgatgttttattggaagaagtcgtagccaatttcgtaaaacgctccgagatgctcttcaactggattaagcttggaagaaggatatttacatctggatcccgacagcgtggctggtggagtccttcgactgcggactcgtggagtactttaatggggatttcctgggtgattactgtttcgcgttcccggggcccagtgcccgatggtctggcagtggcagtggcattgtcgatggtggatgaggagtggtctgttgttgtcgttgcttctgggatgtccagggcattggatgtcgtggtccaggaggtagcgcgaatagttagtgctaggagaggtacgttgccctttttggtgagtctgaggttggctagtttggcggatacggcggagcgcagggcgcggtggagtgcgccgatggggacttcgaggttgattgctccggtgttggattcacagatgtaagactcttcttcgaagatggtatcctgggggtggagtgttagtttggagtaggcttgggggatgggggagacgtacgatggggagttgagcccatacttgcgtgccttggtcggggatgatggtgaagcggatgaagtctttttcaagacgcatccaacatacctttcccagggaggagagggaggcggttagttctgggggggatgtggagttagtatgggggtgcgtctattgtaagtatggtgatggcggcggttgttgaaacacggctgatttggctggggagcttgggtgaaagggataggggatgggaaggccacttactggagaagatagacgcgttggctatttgagttcgaaaacgcatcttgaatccagggaactacttgcatggacagagatttgatgctacactagttcagtctgattgaagccgaagacggtcgagactcgagcagaggtgcttatcgatgataagttcggggatcggccgcgacggtggagattcccgccaatccgcgaaccaaacatcgcgaaaaaggggatcgccattgcggcgggaacaaacaaactattctgtacgtcgatggttgatatttatctatattgcattccagaactgagatcgcacaatgggatttatataggtgatatgtcggaagattgcttgctatcagcatattcaataggtatcaccaaggcatacgaaagggagctagctagctgtaagcttttcacaagctgtgtactatccataaagcaagcaggacaacaactgcatagaagattccatgttatttcgatgaaacatcaagcaaacacagtctggctactggctgtgagcaagtcatctctcacggacatatctccgcatacttcggggtggcgctcagcgcctcatcgacttcatctcagcctgagattcaacttccagtgaaccaagcttgttatttttgggttcataactacagagtacgtagagtctagacttgatccgtgtgctagaatcgcaaggtaccttgttcttccactactccttgcggatgtcgagttagtgaaatggccagtgggatgctcttgtcctgtgcgccccctgaagtaacagtagcaatccatgtttccatgggatgtctcccacgtggttcgtagcattcctcgattgcttcatcttccttacatgtctcatccttactgacacaatgatagactactgtatggttaggttttccaatctcaagggatcacggacgggtgtccgtcccttgctccctttggagaggggaagtccaggcaccaaagggtgttagtatccctgttaatgggattgtattttgggttcatctactgttcatacttccgggggtctgttagtttgtcgcacgattgacctatgtatatcttggtcatgcctttctttcggatccttgcctggtccttgattgctatcgaggatcacgaaggtcaaggttgccttgtcgcctggtacttatctgtctacgacgacatccatagtagtagtaatgtacacgtcaatggacgagtagaagtggctggccaccgcgattcaacctcggatatagagcaagaaggtaagaccacttcaacggctgcaagacacaagtgggtgtgtttgggtacgtgggtaggcggatgtgcacggaagggaggacacagacacagacatagtccaaggtagctcacgaattccaataacaagccagatacgatatgcaagggagggtcgatcactgatctgctatccgtatgataaactctgcgctcgagcaatcagaagcaagaattaaaagagattattgacaagcggtcgaagtcagttcatcgtgcacgaccacttggggccgcactcccatggattgtcaacccaattgattaccaacgggaaccagcggataaaaaagaggcacggccatttattctgatgaccggacacagaaccaaagtcagagagcggatcttttgggggagggacccgcatcaactccgaggggaatgtgtcttctttgctgcatgggactggagcctcgtgtgtgagacattaaggagggggtgggagattttcccttctgtactgtaagtatgtcgcacaggaaaagtgcattttgaaatgctggcaccctcctagaatgggcacctgagatccaatgctgcatcgatcgagatttctctgaatattctctgctttcgttttgtgagggggaaggattattcctccgttggtctcgacaaaaacaaggcgcgaataagaaggagagaagaagggaagtagtacagttggcagttggtgaggctaattagtagccgacttccacagggccagcacagtcatgatgctaaccgactaagtaatatgtaataataataataataataataatgaagagaataatgaagaaaagaaccaaaataaaagggcttccaacgggaatccacagctaattggcatttgctgggtatacttaacttagtaactcgtcttcccccttaatcgattggcggcggctccaccctttttctggcatcgccaaacccgcgcgtctccgtccacgccatcaccaactcacctctgcatatccccgtcttcgaatcatcgtcgccactggtctcgtcactcttttcttctgggcccaaactgagctggtctctccgatcctaatcatcccaccctcgttcttttatctatctatctatcgggctcttcctgcagccacccaactttccctcgccctgggctcccctcagccgttttgaggccctgcagtgtgatctatcatcatccgccgaaactctgctcctctagacttcttattccctcacttttctttttctcgccctagttcccttcctcactcttttgtcagacctttcccccggtgtcctctctgccacggtgctccgacatacacctactgattcattcactgcacctccgcaactgtccatccggtgatcgcgattgtaccagctcatccccaaatccccctcaccctcccgaccttctggctgtcatctttatataactttggcgggatcgcgtcagcatgctcgctcttcagctacactcactctcttttacacttgatactacagctcgacccccatcattgagaacccgttattgattattccgcgactgacctgacccggttatctgggagccgtcgttctcccggagcttgccgttctatcccgacatggccagcagtcgcgtcaacccccttcacccacccactcgtctgtccacggcgcggtcccaatcgccgggccgtccggcggtaccgaactatcagaatctcgacccgttactcggcaacctgtcccccgaatcaactctccaagcgctgtccgcaaccgatgccgtgccccggaatgagcaggccgcccacgatatcctctccaaaagtatctcgcaagtctccccggcagagcgcgccctcggtatccgcgcagccattgcagcccagaagctcaatctatggtataaagaagtccagtcttgggaatggccgaatcggagtgacattcaactagggaagggcttcgtaccccctcccggcgctgccgctgaggagtactgcggaagccttcccaaagccgtagtagatcagcatgaaaagcggattgaggagattcgcgatggcatggatgtcttggatgtggatgagcttaaagagcacgttctcaatgcccacattccagtccggtctcggccttcgtcagccaatagcaccttatcggtgcctccaccactcagctatgttcaactcagtgacttcacggccgtcatcactgccaccattctccgcgctcttccgcttctttcgcgcttgaacagtctcttgtctacgtgggacgtccgattgttggttctgcgccagatacctgaactgctcaggcgactgcgtctggcgcgttccgaactggattctgccttggacttgataaagtcacccactcttcctgacgaagatggtcccttgtactctcgccctaactatcatgccaaaagggccaccttagaactgactgttgtgtctgctggtcgacaattggaccgcgtcctcgatgcgcttgaaggacgcgaggactcgcttcccgagagctggattgatgatctggaggctatcgagtcagagttcggaacatgggttatggaagccgaacgacgtactgtcgaaaacgaatggcgacgaacaattgccactgctgaaaaggatgcccaatatcataccccggagacagcgcgggcacaggcaccacccgagatcagagacaccgacaaactggccctcaacacgtccgtgcctgtgtcacaggctggccacctattccccatggagactattgccgaggaagaagtcagcagtcccgtcgaaccgtctgccccaagtgacgctcaggatgataagaacttaacggcatccgaaccggccgtcatgccggctgctcacagtgtgaacgaaaaccttgcatcttccggtacatccgatgcgacggattctctgatcaagtctgttaaaagcactgtctccatcacccctccacaggaacccttggcatctagctccacggtcaacatcattgcaccttctcccgatgggctagaagagacaggtacccggaccgatgaacgtcgggcgcttccacctgtcacttcggaggctacccagtccttggaggaaccggagactagcaacgagacgagcgcgtgcaatgactcgactcctgatcaccctgattccgagcatcattcctcctcgcttgttcctcaacagacaatcacaaccatgccatctgtcggcctatgcgaaacctgtccgagcctacttgaagaagagaccccacgggcttctttagacatccaggctcgcgacgcagggttaaccgacccgttcaagatggctacagatgcgcctgcattgtttgaggatgggcgcgcagatgtaatgccatcgttggaatctgatgcagttcgtcattcttcgcccgaagtaaatctgcaggctcctgctagccctgatgcacagtcatcggacgcaggtagtgtgattgtacggcgacgaacaagttcagcccagtcgcctctcagccaacaggaaaagcttcccgcagataacgaagtggtatccagagacacccacagcactagtcccgtggttgaaagccgcgagcaacggcagctcactctggacaagagtgaagtagccagcccagtcagtgtggcggcccaaaccacttccaatgatagtcctgctgcgcagtcaggcaaccgaagagactcttgtcaattggtacctgcgaatgctgttcttgagtctcctgcccgctcggcaaactctaaaaatgataagcagcccccaagtcactctatgaacaacgtgcaccaagagtcccatggtggcaatacacccaaaaagcctctggagagtccgatcaaactatcgaggtctcgaccagggcgcttatcttttgaaaaggagaaaaacaaatctcgaggccggcgcacgtctactgattcgtcttgttctgattatccatcactcgtctccagccctgagattcacgagccccgtacatcctcttccaatggaacgcctctgctgcttgagactcctccaccatttcaggatggctatcagtcatccgatccagtaccacctgggagcgaccacacgttgcgagaagatcgtttactccgcctggataaccaaaaatcatccccacgtgccaatttcgcccataatcgaaacctcagtcttcccttgcagcgtttcatcaacgaaaggttggagatgaattacgatgacgaaagcggtagtgatatggatggcgtcgcttccaacaggaagtccacggatgtgtatgcggatttgcggctgggccagaaaaaggcactgttgcctgcacacatcagcaagttcgccattccctccaacagcgcacagcgcgctgcaacccagcctttggatgcaccaagtcaaggaagccctagaccggtcaccaatggcaacaccgctaaagttctgtccaaggcctgggagcacaagaagggctctgttccgaaaaatacaaaccgaagtggtctgcagtcggagccgcctgtacactcaagcaccaaccgcttgaggagacagttaacttcgcatcctagtcttgagagtatcggggcgtatagatccaacacccgatctggcgatgacacgtcttcggttacagctatttccagggctggatctcgaccatccaccccaggctcacagctgaggaaacccaaagatcacctggacgagaaaatcagttctatcttgtcaacccttcctgctcgaatccatctgatgtctgctgatggccaagactttgatgcgggttctgcggcgacgtcaatccccttgaaggctagggaacggtttcgttccatatcgccccagggaacaccgtcccgtagcagcacacctaccccctccttgaccctgacagctgcgccctcgcgcaggagatattcgcatgcacacgccccagaggagagctccgtgaagctctaccacctccatcgaggtggaaaggttgccccgaccaaactttttgttcggtcagtgggtgagaatggagaacgcgttatggttcgagttggcggtggatgggcagacctggctgaatatttgagggagtatgccatccaccatggacgccggcatgtttcagatacccctcgtgttgaagtccagggcctgtccacgcgtacctctcccacgtactccgttagtgggcgtcgcactccctcccggccgcggtctgtcatcggcaatcggccatcttcatcattggctgtgcgcaaaaccagacgcacctcgaacgtgtcggatgtaaccgagttccgggcggcgcaggcagctggcgactcgctcactgcctcgtactcgcctatgtcgactgtgtcatcccgcagaagactgtcagcttcatccaatgcctcaatgggcgctgcctcttcagccagcgagttccgtcacggatcgtattctccttccaccactgctgcaggtagcaactctcattcgattccactcggccttgcagggccgaagccgcggtcgagaaatgtctcgatcagcccagagagtgaggcgtgggttgaagatgttcttggccaagctcggaggagctcgtccttaaggccttacaactatggcctgtcatctcaggacccggagcctgcttcagccaaggctccaaccatccccaagtcgagaagtatcagcgacctgggaatggccggttctagcagacgcgtcgcactacgcggacttgcaaaacgataaacctacaaacaatcaccctaatcttaatccttccatacgctcacctgatctacactctttctcccacacacactctctctccgcccctcctctcgcctgcattgtctactagtactggcgttttgccgttttcctgggtttctcggtttggacacggggtactaaaagtgttagacagctgcattgtccgtttccttctttttcggttgcattatcgggcgaaggtttctttctctttctcttctttcacattcttccttttcatccaagacatgcatcattctgtcttggctatcttcatcttttcccaccattgcatcagcgggtttcattcttgttttaccacatttttttctttctcgttactctctctcctctatcttggaagagatgttttctccaccttcggtcctggttgaccggccacatttccgttctattttcgtgactcctgtctgtatctgtctgtgtccgtttgttcgtgttcacttattattatatttagcccttgatttgtatgtagatacccttaggtaggcttgggtcttttgttgttgttgatgtcgtccgtccgtcctcttgctggatagaaagaaggactgactggctggcttgcttgataacttacttagtacatagtgagggattatttgaatctgttgatattacttttgtccatgttccgttttgtgtagttcagtagattcttaatgtcagagatactcgtaaggaaatggatgcattgcccagataagcagtagtagtagtagtaatcgcactacgcgaaagataatagaaaaacgccaccataccgtaccaaaccaaaccaaatcaaacgaatcccgaacgagcaaatatccagatagacgtccatcaatcatttcattacatggtacaaatgaggaagagttgagaaaaacaaaacgtaacaaacgagtcataattcgtgatttggcaataggcgccaatggagaatcaaagaaggagaggaacaaagtaggtgtaggttagggctctctacgatgacgactctcctttcgcaggctcttcctgctgcttctgctgctgctgtttcggaggcgatttacgtgcccatggaatgtccttgtgaaaaagttccctcagttccggggagaccacctttgtttctccttcactgtcaggtgctgaactgggaccggcactgacgccactgctgaaggcagtattttggggtcgttggggtgatttgcctttattgtttgtgctagcggaggagtcttgtgtgggcttccgttgatgggcggcaggtgcagggaagttgtttttcttgtcgatggcctggacggctcgttcgaagcggtggaatagtgattcggcgcgtgtgaggatcggaacgagttccattgtattggagagttcgttgactgcgtgagggcggtgttagggatgcttgtataagtactatggaagtgggtggtttgacttactgtacttcaaaacttcgtcaaactgcttcaggtgatccattatgacatcccggtgcttttcgaggattgcaagtgcgatgaaaaggtggaagctgctggaaaggtaatcggtccataatgtttcccagagacgtaagacgtctggccattcaaattcgcgcttgtaccagaccaagagcatccggaagaagaagaaaaagtttgtgctgtcagcggattggagatggagatagagctgaggatccatgagttgaacaaggtggtctagagtgagaagttgcacacgcatgccagattgatcgcggaggaagttccgttccttttgcacacatatcagcatatgaagaagtaggtttagctgccatcgagcttaccattctatccatgaagccaacaaatgcccagaatgcaactgcatcatcctgcatgacagcatagatcggggccagaagatcactcatgccttgcacatagcccagatcggggttgtattcgttgtacgtgagcaacatatctttcatctgttcgaggtgcacgttcgtgcctgtatccgcaaagggcgaatccgggtctgggtgggggatatcttcccctgcaaacaggggtatcgtacgatctgtgcggtgaacatccttctctgcgcgcatttgtaagtaaaggcgcacagtacttaggctgcagacaaactcacctattctgtttctttgctctttccaccagtcatactcttccgccgaagacgtgccttcaatcatccgttcccaccaggcgcccttaagccggatgtactcatcccgcttcgagttcatcaatgcttgccgttcctcatggctactatcccacggatatacccctagaaggaagagccatgcctctttcctgacgccatcattcggatccaatccgccatggaatatcctttccttgacttcgtcaacggttacatgtagccgtccagtactcgggtcgaagaaaccctcccactctttcaaagtgagtatcttccgacggtcctggatagacatggtacctgtctcaagatcaaggatttcgaaatccccaacagaactattctccatgttaagaacatcttgtgcagtaaatatacgttggtttctttcgcgttcactttgctctgatatgctcatggcccaccgtgctaggtataacctggcgctatcaaactcgtcctgtaaagtctgaatctcaggtgtcttcataagacggcggacttgtgggggtatccgagggttgtcagctaactcgttagccgtgcgccttgtgaaggttgtgattttgctcagctgctcaaggaccttccaccttgtctccttgagtgctttcacaaaggggtccatcccagcatcttgttggccgcttccgctggcctgagcaacggcagccggttgatcttgagccttgacagttgagccatctgcagttagaggccgtccaaatgatatgcgatcctcatccgatgggttgatcagatatacactattgtccacggccgagcgctggacctcagcatatttccgaagccatcgcagaacttcatccccgccccagaagacatttccatcctcaccgaagggatcaaaactctccctggttcgcttcttcttctgcagtatcgtcgactcgcactccgtgtcatggaagaacagcgcggggaagctgtcgcctgcgcgagtgttgatcacaagactcccaaaccaccaccccagacttggaggtcgcacaaggagtgaataaatttcagacagaggaactgcgaacgcgtagagcccgatcgggtccttataggttgtcgtcgtcggaagagcgggcaccaggtatttctgtcgcggaggggaagaaccgtcggataggtcgactttaacataggtactgtaggcatcacccaaggaagattcgggtacccatgctagaaggtaggaagagatgtccgaggaggagtttccggaagtagtatctctaagaggggggaggggcttttgttggacgagggcaataaatccggggatgttatctttcgaggaaggagttggatgcacgtagacctgcaatgctcggaatcgaatggatcagcgaggaaatccttctgccagcttggaaaaaagcctaccttgctcttagaaaacagaagcttgacgcctctgcgtgaggtagaatgagaaatggtgttgtattcatcctcctcatcgtcactgacgtcgtagtacgacgccgtcggcgagggcggcgagggaggaggggtgtattggattccgtcgcctgccatagcgaatggaggaagcgaagaagtgactttttttttcaaggggctaaagtgattaggtcctgctcataatgcggactgggtctgaaactggatttccttgaagctgcgctggaatgcccggaaagtcagcgccggtcggcaaagtgatgattgcggagagaaagcaagtcacgaccgccggtcacgacgtaatcgtggggtccaccgcttccatgtgatcgccttcactttatcaaatcaccccagaggaagtattcaacttactttgcaagtggtttttatagcacagaatatcgaacagtctgcctgaaatacggtgcttgtttggttatgtaggtcaacactaccttgttactgagcacctccatcgttgccaccgataaaatagatgactgaatcgcccaggcagcagcgaaactatcatcttgataatccgctatcaaatcaatcaatagcaaaagaattcgttgtccacgcggtattccttcacttgctcctactatcctgccaaagctggtgtcgaatactgtagatctggtcatcgccagcaatgtgcacaataccaagagcgacgcgctgaagtagacgggtccctccaagccatatgacgtactatttgagcttgaaatcgcagtaatcactcaacagttcgcaggctgggggactccagcagccctaatcaacgcaaagacaatggaataatcatgtattattctcaggagaaaattccaccgacatatgaaaagcgttatcttcttatgttgagcaacgggcgtggcaatagagggaggtaacctaccagccatgatcagcaaatgctttcttttagtagcaattccattaagaataaaagtactacccataggtgctcagttttccgcccagaaaaatccaattttttgacatcggccttccatgtggcatttccgttaataagaagttctatagagtcctcagattgggcattcatcaatactactggtactacggagtcgtcgggcttgattagtcctgatactctgcacacaaaagtactaccttggcttaattttgccaaaacttcagaagttttgttgacctcgctcccttgccaagtcacgtcaagcagagaatgaccaaactagtccggacaatcctacgtgtctggctgacaggaacccagccttgcttctggaccggtttcatctgacttgccggccttcagtcattcgtcggtacaaaggacctagcctatactatcttctctattaatgcacgggattttataccctcttcaggaaatgattcgctatccaatggataatggttccatgtactccatgaggacagggttgattgcctttggacactggcatccataaataccagactgctgcttcatgcagtttatggacaagctgcgtcgagactatctcaactctcagcaatgacagaacttatgcgcactttgccagcctcctggtattgcagccagcctctctatcagcttgaaagaagggcggtattcttgaaagtacgatcgacttagcctcgaaggtattcgagcactaatgttctcagtcatggtatcttgtcggtcctgtcaccagattctgtgatataggcgccaaggttgaatatgagatagctcagcagcctatatatgtggttcggtgctcgggggaggttttgttccctggacaggacgagattcaggtaatctgcgcgaaaagtgtaggtgagctcggcattttcatatgcatcagactggaaatgccttcaaaaccacgagaaatatgtctatcaagtcccttgttgctgaaaataatttaggagcgacccctaaagcaccacgtcacgccaacaggcctcgttttcgctactctctcggacgaggcgcccagcttccaggagtatttcccggacttggagccactactccagagggtgaacttcaccaagctcccctacagacacagcatcaaatacgaggggcgattcaactggaagactatgtatttgacactctacctcgtgttcggaaagtgatcatgtcccccctgacctagtttccgcgacagggtcgatggctaccaggaatgcctgcattgccaatacactcacccgtcattctccgtatactacccgccaacctcgtacgcggtgcacaatcatcagaacttttcgcagcatatcgcagatccggaaaagcctgatgatggtctattcctctacttcttccccaattgcactctaaacgtctatggtgggggaatgtcctcgttccgagtatgtccaacagaagattcgaacgtgacgaggatggagtttgactactatcatatggagtctggcgagaagtttgacgaatacttcaaatttgtgcggcaggtggccatggaagactatgaactatgtgagaaggctcaaaacaacctcaccaaaggcatctatagcgaaggcatcctcaacccagaaaaggagagcggtgtttcatgtaagttgtgtgacatcaactcgtatatgcccaggttactctaagctaattagagggcagattatcaaggccgggttttcgagctcgtgtgtcagcagcacacagcagagagacgggaaagggaattggaagatgcaaaagacgatagtcagaagaggggtctgcaacgtatcacaacagctgcataagacaaagctgtgtaagccgtggtttcgggactcggtagatgctcaatattatcagtggcgttaatttcagtgtttttcacggcttggctcctgtgatagtccctgtaaatgattcctatcatgatgtggcatcagataaacccttggccaggatcggcccaacacataccttaggaatcgtcacctcatgcgcaggttactggaaaagagcaccatatctggaaggtcaatactggtctggagtagatatacttaccttggtgcatggtcacctgaaggcttctcctcctctcactggacggggaaacggaagtcatgcaaacttgtggaggtgacagggtcagtgctctgttcctgatactgctcgattgaatcctcaggcctctttcgtgcgataataagcgcataaaaacaacgagttccctgtagaaaagcgtggcgaacaacacattttcaacatggctttagaagaactgagtccggctctgtctcacgccttatcagccttggtcttgattgcattgctggcggggctagcctttctacttcaatctttatcacgaccactattccgaggctatgagtccctgcgtgtagataagccgaagaaaaccgagctgaatcccgtctccgagggtagcgagaacactgtccacaaggaatcagactttccacaaaactggtggactggctcagatgtctttgagttagaaagacgggcaatcttcagtaaagtactgtgcgcctcgattacttcacttctgcaagcctggagtcggacgtgttgctcacctaaaatcaattagagatggctataccttgcacaccgtagtcggttcaccaaacccggcgactaccattcatttgaagtagccggtatcccgatcttcttggtgctagggaaagatgatatcgtgcgagcgttccataacgtctgccgtcatagagcatacacggtcacgaggaaggagtgcggctcctctatgatcctcggatgtcggtatcatggctggagctataacaccaagggacagctcattaaggcgcctcactttgacaatgttccgggctttgacaaatctcagaatagtttattttcgatccataccactacagaccctgctgggtttatattcgtaaatttggacgcatctccgacgctgttgccaatgcaaacaacgtctctcgattactttgcaaccagacacggcatcggacgacagtctacatggctgggaggtcaaacagtggaaggccagttcaactggaagattggctgtgagttccttcctcctttcccttcttacaatgtatctaatgtgtaattgaaatctcggaataagtgaggttacagaaattcatcgaccacacagaactggagaccgagttcccacagccaaagtataaagcgctattattgagcttgttcaaccaaccacgaatgcgctcggacgaaacaagaatctttccctttactacgtttcataccgtccacggaggggtactctggtactccttgagcttcattcccatatctgagagtagcacctcggttcggattgacttatactcccataaagacatgagcagtccggcgccttcagcagcagcagaaagactcttcagcagattgactaagcgcattcaagatttgaaagcccagtttcagtcacattctgggacttcaacgtacgttctcaaaagcaaaatttagatagagaactaaaacaaccacttctctaggctccccacctatatcacctcagcatcagacccagctgatacaggtaagctccaacccaagaatcccctttatccacacatcagtcttaccaacaacgcatcagatgcgcaaagcgaaatcctcgaggccgtaaagtctcacgccaaattagaaaaacaactaggaaccgaagtcttccccgctacgagaaggccaagaaccaatgcacgattcgagcaggccgaacaaagtcagtcggctccctcccatctcatacctttctgtcgtactaaattgtatctgtagtttgcaaagacctagattgccaagacacgtggaacagcaagagtctcgcctggtgagaatgcataagcacaagtatgagcaggacgaagtagtattgttgctgttgtggccctggtggcctcataactcagttgaaacgagttggttaactgttgctttaatgatgtttaatgcaaatactcttatgtattgattcaaggggtactctagggccactggggacagatgtcctgtcttccaatttgtctaacacggcggtttcagactgggcgggggcagttcatttattcctatcagaacgaacacaacaaatagttgaatgatcttacgcaaacacagatagaattgggtagtagcatatgtaaggattatcttccttacagcataagcaacgcgagtaaaacataaggctggctgcttactattaatgacagaatagagagagagaaagagagagagagagagagagctccgtacattcctggctcgaaccgaatgttggtgtggatccgaccatcgtcccaagggtccagtggcagcggcagcgtgtaaaccttcccttttctcccttgaaacccaccccacacttcacctcaccgatactagtgttgatcagggcccatctacaacttaactccacgggcgctttaaaacatttaattccaggccagacaggacacatctccttctgagaattctttatcatcattaactcactaccaaactccccttaacgcaggaacacacttttagcccccaggtctcatttaattaactcgccacgcggttctgggccgatcgatttaaaccccgacacgatttagactagacaagtgctgaagatcgccaacaactccgatcagacgacgattactatcggtccaagtacggagaagaccttgttattttccggccacgtggctgcgagctgacaccggagcaggcaatacgaacttgtggcacacgcgttggcttgactactagcatctaccatggcttttcctccgatagctagggcgaccttgcaagctgcgctgatcaatgctggttccaatgttctggctcagactattggagcttacagggatgaggtatgttgatttgttcctcggtaaaagtaaattgcctagcaaatgatgtcgggtcagagataaaatgattcgttcgctcttgtgtggagtgatagctactattcgattaccacttcactaaccatggatatggttcattggcaatccgtgtgggtggccccccatggttgccgatattatgatgcctatagagaccctttgaattagacactcaagccttatttcagttcactacttgtgccttcgttctttcacccttgaccttcctgtggcttgaaggcctcgaggcaaagctcccgggctatgatgagagctctgtccccaagccaaaagcggagaagaaggtggcacagaagcccaggctaaatgtcaccaatactgtggcgaagattatcatcgatcagatcatcggcggtgcctggaacacggcagtctttatcacgacgatggggcttctgcgcggccagagctgggacgccattacgctgcagatccagaaggtttgttttccaggcttgtattaatatgacctgtactggattgctgacctatcattgtcaggatttctggcccatcctgatcgccggattcaaactgtggccaattgtctctatcctgaacttcaccgttgtcccaacagacaaacggctactcgttggcagtctgttcggtgtgctctgggctgtttatctgagcctgatgtcgggttgatgttgtatcatgtcaactaaggggtttgcttaaattgccaggctgattggtctatgttggaagctaagttgggcgctggggacctggggcctgcggctggtgtttctgttggtttcgcaaatatttggacaagaattctcaagatttgcaacttatgcttcctagagcagtagcacatataacttgagacatttattacttggccctaccgtgttgggtaagctcgccagggggagcaacagagcaccggcaagcgcacacaagcagaaggagcctgatcaaaccaaagataaaaaggggccagacttgaaataacggcagtccgctagataagtagttcgctggaccatgctccgcatgattgtcaggcaacgttgagattgatgaatggtttgttgagcgacccgttttgtttccatttggcccccattttccgtccccgagtaaccgagagctgcaatagtgaagcctagctggaccgtaggcccaccttcatttcggggccaaaacacatggacgacatacgatgcctgaagcccattcttcccgcatttctgctgtttattggacgacgggcgttatcatttggagatggatagtgaatggcgagaaccaggaaagtacggtccagtgcgggtgtacctgaaccgtaacccgatacggcatggcaaggcaacttgaacccaccttggagtaagatgatctaggctatcatcgcgtaggcaactttccttgtgtcaattcaggaggtttggagaagatacgctgttaggaagcttctaacaggagtccgtcaaatcgtggtcaggtgatatgtttgggggctcattgttgacaggcaattctctgccttgcgagacacgccgaatctcagaatcgattcaatctagatgaggttcgaattggctgcacgcccccgtcacaccaacgccaatttaaaccatgatgctctccagaaccaagtgtttatttgtcgagcagttatgtagtaatgaaaatagtaatccatgcgaggaaacaaatgaggcgttggagtccgtcttagctaagtgatcggctgtctcaaacacatttgcattgatcctgggactggaggaaccgaagaacaagcgaccgttcgtatggatggatcgatccctcgattcttactaagaaagcatccatcgttttgactgactattccgtagatttacggagtttaaacacggatttacccgcagatcactttcatcattgcatgcaggtatgagtgtgctccgacgtccgaaggccggcggcatgactgaatccatgatgctgcacccacctacctgggttttgcacgaggcagacagggatggatagagacggcgtacgcaatctgctgaaaattgtcatcccagtccgggtttagtgttctccctatcttattcgtgagacactgccctgcactggaccaaagtaggttaaggtgggttaatggggtgtaattaatagatcaaggctgtggctgcagcagaattcggtaacggtcatacgagctgaagagacaatggggactgcgggaggattggcgatcagaaggctggtggatggcgcagccacaacgaactgggggtctatcgcagattccacatctccagtaccgagagttgtcctttgaacatggagggaaaatagggataggaatctccgtaaggcgaacaagaaagtgagattattgtcatcccgatgatgaatagattgagggggatgtttggcccctcggatccggaagacgggcggagactctgacaagaaacaactcgctttcctccccgggataagttgcacggacaactacagtagtctctctcactaaaggtgtactatctccttgtagttttggcccccgcggtttagtcgcggcttgacaagaagtcagtcactgctaggagtcgatccattcttcgtggcaccgtctccctagcctatcgctgtgcattgctgtgcccatccacctctgcttactccataaaatattagctggcgtcatgtccccaactgcccggacgcgcattccctcccgatttagggataagaaaagcatctccccccggcacgtggggactgcgacgaccgggatttcgagtcagatttcattccagtcttacttgggtaggacttcaatggcatttctatctgctacaaaccctcatatgctcctagctgtgcatctcgaaactctttgtcggtcgcgcgtcatctgctccctcgaaactctttttctttgttcgcccgctcggcgttgactgtcagtatactgaacccaacactgcgctttccgtggtccctttgagctgatccgtcgcgaacagtcgggtgccacctttcgcaatccttgtcaccctttctgaaagggttcacgcaaaacttgggaccaatctttatttgattgtgagcgcctcaacggctttttcgcattcgtctccggcccctccatttcggactccgctcgttcggattttgggaggacctacttagttcggccagtcgtacttctaaatatacggaacaatccctggaataacattgtcggtccaaacaaagaataccaacaagggcgccttcaagaccatgttgtacatgtccctaaacgaacgggtgcactgtgccatatgacaacggactttgtgtataggtagcagccaattgttacgatcgaaccatccaggtgccccaggggataaactgttggctcagttcggaagccagtcctacgttaaacaggctctcaagagttggtataaggctaatcaaaggccccctcagtcccaaagatggaggtgatggacatgcctaagcgcaattcacccgtttcacaacccaccgctgtcgcaatggcatcaacatctcctcatccagagaaaaaagcgtcagatgccccatacatcgtggatgacgacttccctggagatgacgacgacgacgatgatgtttcgatatcgcctatctctgagagagcacctccatggtctggaactcgctgggctcgttttttccccgaattgtcctctcacttctccttggcgtcccccactaacagtacaaatccgccctttccgcaacctctcacgaagggtccgcctcatattgacggtccttcacagcaaccagagagaagaagcaaagggccttcatctctgtcatctgaagatgtggcagataacaggtcatcaagctacaccagcaggtcttccttgacgagtcagggatctgaagctacatcaccagttcataaactggtggatagtcttcacataaagtcacccacgaaagctggcgtgtttgacgagtcaaaatttgcgcatcaaattcctcctccgttcccgagccgctcttcgattgctcagtccaaagacaagcctctccctcaggagcctcccattgagttgactccactctcaatccgccataaaacacctcaaattcctgatagacccggataccttagccggttggaccctccgccacgctcaaaaaagcatgcaagtcatcatcatccgacgttgtcgcaggcgtgcaccgatctggagaggactctagccggactcgctgagcaacagcacagtcccgcgcaactctcccctcgcagtcctcttcaaattctagacgggcctttgcagattagtagaggcaatatggacatggttgctacgcgaccagcccctcgaccccctgctagcgtgcatgataatcgtcagatccacaaagccaagtcccgcgaagatatgaaacagacaaagaaactacttaagaacaagccgtccttttccttcacagtaccagctttcggtcggaaactgagtcgtgtccatcatcgatccactagtaacaccagctccaagtcggaacctgaatcctacagggccagcgtcttacatcagccagctgtcgcagaacttggagacagcgaggtcgctgagttacaggggtcttcagtcattggttttcgtgagagaccctcctccgctggcggagagaaggaacttcggatgaggcttccccgccttcagacaaaggaaatgggggcccccggtcggaaaagagacaacatccacagcactcatgaaggccctgagcagcttagaagaccaaacggcagagcaaggggtgcttctgtcggagaaaagtacttcgtatcgtacagtaagctcgatggtatgccggtacattccactcgtcaacatcaaccaacttcgcaaacttcatgtatggtctatgagctggagggtggttccacacaaccgcccgctgagctgcaaggcgataccaccagtccgatcgatgtggtgcctgtcaggatatctgtcggtgtatcatctgtcggggcaatgcctggcactttgcccgaccgcgttatactgacggtcttggagcacatcacctcccttgacgaccttttcaatgttgcggtatcccgcaaagatttctatcgggtttttaagatgcacgagttgaagctcatacggatagccgtgttcgccatgtctgcgccagcatgggagttgcgcgaaatgagcccaccatgggataccgaatggcattttgtgctggatcctgacgcccctgtgcctgaatacacgccaagctgctacctcaagcgctatgctgaggatatatacacactggctcatctcaaatcgcttatactagctcgttgcgggacttttctgcgtcccgaaacgatccgtgggctctccggcaccgacgatatccgtgctgccgaggtcgatgatgccttttggcgggtttggactttctgtcgcctttttggttctgggaaaggtagagagggagacattgcgggacagttggattggctgaggggtggcgaggtggccaggaatcgacgtgtttccgaattcacgtctatagccgatccatatgacgcaaatagcgttttgttcgaacctcctaccggatttggggacggcaataatggaggcctatcaaaggagcagcttcttgatatgacagagatatggacctgcttaggtgtgcttcttcagccaatgcacggtaagtgtactgaagcacgagcaactggagtattcgatgggcataatgtagaggcaaatgattctgccaaggaagcagcagttctaggtaagcgaatcccacccttatgaagttgtcgtctcactgtttccaatcactaacccgtttgagcagaggagtgggcctactacattctcacacttggactctcagcagtcttggtgctcggctccattcatccctatgacaacactactgctgttttccagagagctcattccatgggcttgacaaactgggaagcatctgacactggtgcgagccgttcatcattcctgagagaggccgtgtcgaaagcttgtcagccacggggaagtagcacgtctcaggcgtcgatgcgctcgtctggctttagctcccagccttcagggtcgcatgatgtatcacagacgtctaacgttcgcggcgagagagagccttcgcctgacttccatcgccgacggcaagccgcctattctgcccagttgaggattcagagacaacagcagccaagtccgcctaatcctatgctcgctgaagaacggcccatatctcattatgcaaccatcatgagccgcctagaaggccttccgcccgcgcctcagccgccaatgtctgtatcgaggatagaaataccgcctactacccactcttacatgacgaatgtgtcctatatgcaacccctccaatcagtcacaccagtgtactacccaccacaggttcgcgaccctgttgaccacgccatcgacataatggttcgagagcttggctttggggaggaggacgccaagtgggcacttaagataacagacagtggtgaaggtatcaatgtaaatgcggcgatatccctactcacgagagaacgcaagacccatgagcagagcagtaggggattttccttgaggaaacgcaaaagctttctctcctcggtcatcaacagtccggagtcgagacattcgggctggaaatgggcttgagcagcacgacattcttatggattgttgttgctaaatttcaacatcaatgacagctagtctagtccttgttgtacttttttctctttttctcatgactactttgcattactggctgcctacttcttccgaggatctcctttgactacagggcgtttgtttgggttgataccactgtgtaccacaattttctgtagctttcataatttactacaagcgtatatagtcatctttcaccgatcatactttgatcgtccagctatgttattattccagactcctctatttacgggactgggcttacaaggatgcccacgacaagggaaatgcaaccgaatatccgcagatctactgaataactccctccccttcttagggatgtcacaatttgaaatccagcatcattctcgtaacaattcaggagccccttcatgaggctgtttaaccgtgctgacagtgctgggatggcgcgcctctaggaatcaaggcggtcttcgtcagccaatttgcaaggagcccagtgaaggacgggaagctagcaggagccctagatgaaggcaaaatggccatctactctgtgtcgagagcatttgaaattgttcatcagctggtacgtcacgcctgtccacgtactgtgagagggcggaccgtggagggaatgctgtccttataggccagcggacatcccgaaccttcttcgacccagcctgtcttcccgctcaaacccactgcaaaccgaatagcaagctcggctttgaaagccatctgctgcggcaggcgttcttccctggcgccatggagagagtggccagagtattgaacagaagggcgaaagtttaatggttaatcatatctatttccgatgtgacaaatcgggtctgaaacaaacttccagactattgtctcgggaactgcttcgatgctcatcccacccagttccgtggtggttcttcgggtgttctattccagttttctagcttgcaggaagcttcattactttatgcaagctgtcatggacacggtgaggttgaatggatcccgcttgcacgcacgtctggacgtgcttcagctgacagccaaacacctagcatgttctttattcattggggaccccaaccttgacatgtccttagaagcaggtcgactagcatggatattgctggaactatctcgtggtccagccaattattggaaacgtccctgacgcggctgtgatgtatcaactcgggaggagagaagggccccccgacgatcgcaaacgaggcttccctttgcttttttttgagtcttcgccgagaggcacgactcagcccgggagatctgacaaatgatgtgccaatggcattgcttagaaggtgaaaaatcatcaacaagtcaataagggaaaaaggaacgatttgatatgatatatctatggctcgacttttgggacagagataatgcggtgagggcgcagaggcgcggacaggtttgaccctcgaacttgttcgacgcaaggggggtccgtttgtttattgcagggaggaaaacgaggggaacataggcaaatgcactcgctggctgcatcaaggcggtccgtcagtttgtggaatcaagataatgctctcgatgctggtgatgcaaaaagatgaacggcaaagcctgccaaccaaccctgtcgtccatccctccctcggcacttcgatcgatcaatcgcccaatatatcacttttcgctgaactcaagcgcctctccttcgcaagctttgttccagactaacatgcgagggatgacaagcgttagcgctagaggagaaacttccccagtgcctcctagaaaccatcaagaatggggcaccgccgtttacttctagacaagaccaccggctgacctgcatatgtatgtatctgtgccagcatgtccaacagctcattaaaagtgacgcctcatcctgacttttaatggtctgttctcgttccgacattttgtttgaaacggactgccgcacatcttcgacgtcgtcttttcctctcattctcctgtccttgtgcatcctcttcatatccccccaagatgactacggaatccgtttccgacgctaatccgtcggttcagaggtaagttcacgcattcctttgctgtcatggctgcagcctgtatgggtgatcaatcaaccactaaccaacatcgattggtcagagatttcggcgacattcaagggctgcagacggaggcaaagcgacaattcgataccgatatcatcctgagaaactcgatacaaggtgctccaaacagattcgaggctaagggccgtgttctaagagcctcagacgtgctgctctctttagtcggcagatctacgagcggtatgctgcccccggctacctacatatgaatgcagcctgtggttgttttgcatcggctaaaattgggattaatctggctggtagaaacggatgatgcatatcccggtattgcaagtcctcaggaggctttgcgttattttcctccgttccgagacgatgatgggaccatatttggtgcagtggatatcaattgtcccgactgcgatgcggttttctcttcgtcgtacgaccgaacctgatattgccccttcgattggtacacaatttgacaagccatgcaggagcgagctgaaacatcactatctaacaaaatactgtcctggcactgcgattgccgtctatgtgatgacgcgggaccggtatctgatccttgttcgtctcgtttagatagaaaagctgacttcatctaccgtaatagtctaatcacaaaaggataccgcgttgagaaacgctttattccgctcaactcacgccccatctgctttttctgtggtaactgtgaaaggccatttacatttggcgatggtgaggaagaagggcttgatcggcaacgaagtatgttttgccactgtcatgttcgctagcggagtctaaccaagtctcagatacgccatttttggttgactgcaagcactgtggtgaaccatgcaatgtctcgtcagtgtcccctatggttgagatcttatgtgtaccgtggactggttctgacgtgaagattgcagataccagccgatcttgaacgatccgcgggacgacatcgttgttagaggcacggccagagacatggctagtgctaatcacagtcggagttctagctttacgcaaaaaggttccatgagctccaaagttccatcaacgaacggcactggggaccagtccttttccagaaaggcccgaaagatacgtgaatcatggtcgtttagaagtacgttgtctccaaaccagtcactggatgttttcagtactaatactcccaagagttctcacaaggggaagaggatgagctggtcgctatcggattctcggggctatatgacctggaacgaggtatgtcgcctggtctttgattttctcaacattctaatgagaatggcagtacatgccccccacggcatctatcagcaaatcgaaggcaacaatgaggcgggcacaacgcagtcaacaatgagctacgttaccaatggtatatacgaagccgactgagtagccataagctcagctaatcttgtgactataggggttaatcataatggatccatagtggagtcaaaacggacgctctgtgaacaggaaagcggtcatcccagaagtgacttgacggacaccaagaacgagctccggaatggccaggctgagaatgaacgcccgcaagcgcaacaaagagcctcatggaggcaatcattcttgcagaggctcttcggtcgcaaggttcccaaaggtcagtatgctgaagccaatatatcgaattagcactcactactgtaggtgtctcgcgtgcacgatccacctcagatcgcggtaagaagttgattaagagggcgaacaccatacggttctcgttcgtcaccaagtacacgcgaagcgaaaggagagcagcaacgacccggaagagtgacgtggttttgacgagtggcaggacgcaggtaacggagcctacgcaggaatctgtcgcggataccgaatacatggccttgctacgggaaacgcagaatgtcttcatccacacccagcatatctcaggcggcgcggttgtccacgatgcatctgggcgtcaaaggatcttgaaaattgatgaaattgcacagcttttcctacagattaaagacgaactctcggctgcaagcatgtggtcgcgtatccttcacacccagatgcgagccgagactgctctggagcaggggaatttagacgttgcagatctcaaatttcgcactgccctgagaatgctcgatgagtatccagcattggacattgaccagaactgccgagcggtaatttttcattccctgggacgaacatatcgccatctagaaaggacacaagaggcgactgtctgttatctgaaggctctggggttattcaaacggacgtttgggcgcgactatcccaataacttcgccattctgcatgacctaggagcacttagttcaaaggatgtatatgctacaatagcatcagctttatacgagcgctcgtttgcaggtcgcttgaagacactggggcacaacgccccagagaccctaaagagcatgcaggaccttgccgcgctgaaggtcgctttaggtgatttgggatcggccctcctcctcctggagaaagcagtcccagcactcgatacggtttttgggctgcaacacgaaagaacgttaagtgcaaaaaaccaattatctctcctgtaccacaaactcaaattccctaacgaggcgcgaatgatctgcggccgaaccatccctcaatacaaggcagtcttcggtattaccagtcctatcatgagagaatcactcgttcggtatcttgaatgctctgagaactttgactttcccagtgaaatagaagatatcctcaaccaatatcaacatattcgggaaccagacgcgctgcgagttatcttttatctaggaagagaatatagcaaagcgggcctacatcgggatgccgcgaatatcctcgaaaccttagttgaagacttcctcgccaccaagggaccggaagcgattgagacgtgggatgctctgagttccctctgtttcgcatgcgaacagctcgactctatcgacaaggccatacttgcctacaaacagttagcccttatggcacgacgagccccggaattccgctacctgcaggcgaaagttgatcccgccgaggagagaatatcggccctcaacggacgaagaaatatgctcgcagccgagagacaagaatgggcgttgcatgagcctgggccatgtgagaagtgcggcacccctaccaccaccttgtgcaacagtaagttttccttccctcgcctttcccacgcgcaatcctaacctaacatgcaatgatcagcctgcaagatcttccgcttctgcagtgatacatgccacaaggccggatcagcctcccatgctccccaatgcatcccatccgtcacccgtctcgaatccaagtccatccggatgaagcacaaatgtcccgttgcagcacgcgatctcgccatcaccagaatccgccaaatcgacaccacccgaccagtcaatataacagccagtaccgcttaccacctcgattatcgcaaattcaccaccttccggctgaaactcaaccccaacgtcaacacagtcatcgtcttcgcccgcgaatccgacatccgctacaccatgatcgacaaccctccgcgcacctacccacccagcaaagtccaatggaccactccagagcatcaagaatccatctgctacgcccccgcatcccccaattccgacactacagaagaagcaagataccttctcgtcgccccagggaagaaaatgctccgcaccttggtcgataagcgtgtacgagtccgtggcggcggcggcgaaaaggaacgcttccgagcccttgatatccccgacgaagacctggtcgaatacgcccagggacttgtcctgggtgattatccgtatgagccgttcatgtatatttttgaatgggtgtggaaagattaaattcgaaaagccatcgcattgaagtatatgatatcggtaattgaactaacctctcgggattcccttcgttctgtttcttgtgtgtgtctgatttccttgtttgctattactaactactaccacatatgatgtttcttgtgttttcatgtgttgttactagttactgtgtgtgattctccatgagttcagtgtgtgtgatttatcatgtccgagatttatatataatgctgagatcacccttgctttgaatcgtttcattgcttcgttttcttatttttcttatcctaagtcgataccactaacctcggctccttggattgtccgcgtttggcttcagtcgaagctctggatattatttcccttgatatcagataactgtacaatctgtacgtgtatctcttttgtatcgttgagctttccagtttgttgtatgttatgtacattgagcactaggaaagtgagacgtatgtatgttcagatgggtgcaatgcaatgcaagagagaattaatcgaacgcgaaatttagctgtgattgagtttcaaatttctaacaaggaagggtacatcataagctaaaccgcaaactgatatcctatttatacagctgccaatggaaggcgaaagaaagaaagaaagaaagcgtgactggaacacaacacgaccattctatcgggtagtagaggtcagagaaacacccaaggctatcaatatctatccgtagtccaaatcaaaagaagtctcgtcttcgtaccagcatatacaatgcgcgcacataacgacgccaaacaccatgcatgtctgtatgcattgggaaatgaatgaaagaatcaatgaatgaaaatgcactatgaaagacgtgctcaaatagtaaggtcctcaagctcaggaaggtaattagcgaaaggcgtgctcttgtctatggaacggaactgtaagtgataaatcgtgaggtcgtaaagattattcttgttttggctcggtttatatgttaggatcgattgattgattgctaggagtaagaagggcgcatacgggccccctctcacgcgccagcttcgtcatcgtctgacttgtaagtgtcgtcgctatcgctttcccagtcctcggcttcgagggagcggccacggatgccgaaactcaggatgaacccgacaaaggaaacggcggcgaaaacgccgaatggcatggcttctcctttgtgcttcagtctggatgcgagagagaataggctgccggatagaaatgggccgactgcacggcctgcggccgaaagagtttgagcgagtccgttgagggatcctaaaacggcatgatccggggcggagttggtaatctaggttggccatggttagcttgatgatctttcttctgtcattgacagagatatccaactacttaccagtagaagtgcgcttgtcagcccgccaactgaagcgactgttttgacgagcaacgcaaagcacaactcgatcgccaaaagcgcggtcttcccgcttattccattaccgccatcgctcttgtacccgacaaaaggcattagcaggaatgaaatgacaaagccaaaaaggcccgctcggtaagaccagcgatttcccatcttgtctctcaatttgccgaaaatgcagatttgaaaaacaattgtgacaaagccagagaacccttgagcaagaccgatctccgagggagtcaggccacgcccaagtgggggacgggcttgcgagaagataggaaacagggagttgaaggcaacgttgcagagagcgaagatgagataggtcaaaaggagcagcacagtatcccgattgaatatttcactccgtgtcaatgactcgtggtgtgtctggcgagtctccgatacctctgacgccgagtctagttcgctatcatgatcctgactttcgtacgagcttgtacgaagatggcgataactgccggtatgtggcggttttacccgactcgcgctctttgcagaactagtccactcccacaaccacgcaaacagagcacgaactctttgcttgaaatctggcaaggtctctgcatcctccaagctctcttcgaggaagaatatcgacaggacgaagtccacaactaagactccaccggcgagcaggttcggcatgaggtacgggaaggggttgggttggctcttgtcgaagggattccgctcgaagaccaacaagccacccaggagaggtccggttatgccaccaataccataaagaacaggcagataggtaaaggccttcgactggttgctccgatcagtgatctcacccaggcatgtagagaccagaccttggttgccattgacggcacccatcatcgcctgaacaacgattgcctggtaaagcgttctgcaaaatccaaaagcgcaaaagcaagccgccgtgaggattgtacccagcagaataaccggtttccgccctatgcgatcagatagccagccccagaagtaatttgtgatcaactgtgctactgcgaacgcagtagcaatcgctccgacgtatacaccgaccatatcgggttcgacttcagggaaggatgacgccatatcgggtaggtagggactgacggaattgaaagcagtctgctcgcagagggatatcatcgcaagcaccgccatctgtttcttcggcaggggcgatccgtgccccgatccatgttgagaatcgcttggttggtgatgcgagtcgtcgcctgatgatccagattgaccggagttcggtcttccgcgagatttcggcggcggggtgtcgaaggtctgatagtgcagcgtagaggaatgtcgccggttcagcggattgtgctcttctgtcctcatctcggcaaaagagagatagtacgtgaacctctatagcaagcttcaagtactccccagagaacagcgcgatagaggcggtggctgagcctcactaacaatcagagcaatgacaaatggcttcaattgccactacctcgttcgcgatgcggggggcgttggagcccccagaaaacaagactcgggggtggatctggggcaacagcagcgaactatagtcgcaagtaacgtcaatgacgcgcacttaacgtctaagactggagagaaatatccaaaacaaagtaaaagctgtccacgatcgagagaatgtcgagtcaaggaagaggtgcctggattgtcaagtgcggaggagcaccggcaaacccatgccgatgatgtaagcgttctggctgcagtggaagatccacggctgagtcatgcggtggctatcaactgagttgatatgacaggtatgattgtgaactgttcctgggagcaattgtatgatgtatataacggtcatcgcacaggaacttactcccacattctgacacgggctgtacgtgtcctgagggaggaatcatttgcaagcgctgcactctctgttctcgtggcattccgcgggagatgatcagctacggatcttgtaatccgcctgtcataaagcctctctagaaagggtggcaaagatgtacagtgagctttacctcagagaaagagtggcttctctgcgatcctaagatgtatttcaattagaaatttcgaaactgttgatataatttccgatcttatagcatagtaacgcacagatcaatatatcagctggcctgctggcccaatggtaaggcgcttgactacggatcaagagattgcaggttcgagtcctgcgtaggtcattcttttttggaacttcatttttggttctttcttatcttcatttagtttatatctatcttatttctattcattcaaaccatttacacccctccgcatccaagctctggcctactgtcccgttgccgatgatctgcacgttcatctcgtgtagccttctgctggaaccattatcatggcttctgataggtacgttcttcaaagcgacactacactgtgacccgactaaagattatgagtagcttggactagcctatgtgtggaattcatggttcttcatcgtagtcatattcattactcgccggaagtatattaatgtaagctgcgcgccaatcacttcatcaacaaattgacagcccaagggacactgagtcctctcaggtcaccataatgctgaccaactcccaagaagacaatgggaatacctgtagcatgcaccatgctgaccagcgtccccaccatgtcaccaactgtatcacatttgctgatgatgaagccgtcaaggttccgcccagtaccgaaggcctggttgaaattgcgagcctgcatcacactgtccgtaccaaccaaggcttcgccaaccatgaagatcttgtctggattagcaaatttagcaaacttctccagcgaggacatgaggcgctggtcgttgtgtcggcggccggcagtatcgataaggacgacatcgaagtggttggcagctccgtattcgacagcatccttcgccacgtttgctgcatcctttccgtaacccttctcgtacagctcaacctcgccaacgttctcgcgggcactgagttccctgaggttccgtgcatgaacacgtagctgttccacagctccagatcggaaagtatcgcatgcggcgatgagaacacggtatttgttctgcagtagaaaatagcaaatctttcccaagttcgtcgactttccaacgccgttgacaccaacgatcgaaataacataaggacgaggagattgctgcttgctagtgggagacgtaaccgcatcgatttcacggagcagatcaagagaggaggtaggcgtcagtattttccgaagagatgactccatggccgagcgcaaagcagcatccacactttggaaattgcctgtttttttccccacgagctcccgctggacaccctcacacagccggaccgcggcctcgcgtgcaacgttcttcctcaacaaatgatcttccatggtcttcaagggcttctccaaatctgcttcggtaagggtcttcccgcccacgatattacgtagaagacctccaatggcattgaaacctgaaccgacgaaaccagcagaggacacatcctttgctttgtcgctttctgcattttccaaaatcgagtgaacttcgtctcccaaatctttcagtacgaactggcccttgccagttctgcgtccccaagaatcttgcgacacgccttccacagctggagcagcggcttcttcaccgtcagcatgggctgagtagtcgaggatctgaccatcatcttcatcggcaaatccatcggcatcccacttgcgcatcttttttccgctcttgggtgtctttcctttgcggttttcgtcgcctgaggaagcattggcgctggcgttagcggccttgcgtgcacgacgtgaaactcggccagctggcccccccttggcagttatgatgtggttcgcaacaggggtggatgaccgcgatgtatccggggtgtgcggtggcgtactctcatcagaggtcgccccggctagcgcagcttgatgctgcgctttaggaatgttagtatcgttacattttataaggcccatttagatgcatacctttgagaagaccaggcacaggtggcggaggggggccgccattgtcagacgataccagcgggtctttcttatcgaccgcatgagccacgaatgcctccgaagagataggccccgacttatcctcaagctcccgaacttgctggtcaaagtatttgtcaaaggggtactgtgctatccttgcgcgagtacttcgtaattgatccttgtacaaatcgatgtacagggtggaaatgttgtccaggagtttgtcgatccaaccaagctgtaagagagactgatagacggcctagagcgatttgcggtcagagacagaagagctgagacgcggtcggagacaacagcataccacaaagatcaagtcgaattccttcactcttttccactttagagtgtacttctctttcttgaacgaaggggcagcattgttcgttgcctgaagctggaccttctcctcgatgaagacatcattgataaggctgttaacaatatgcgccccgacgggcgcgtacgatttcgaccacaggactacccctgaggcagtcaagatctcgaatgcttccaacatgctgctgataagtagatatgctgtattggcgaaactggggtacggaggcgagtgaacaatgatgttggagtgaacggcgagatccgcgcagtggggaatttgcgggcggcaagctgatctgtcggtgatccgaagggaaggacttcagccacgtagaaacacacctcaaccttctcccattctgcgctctagtcaccaccgatttgccgtctcggcaacccctcgagctttgaaggacaatctttgactattgaacttctctcaactactttgatacaacccaggaaccatgtaccgccagtcgttcgctccacccccagcgcagtcccctccccttcaccatcctgtgcctcagcatgtctcgaccgtccccatgatgcgctcgccgccgcctccggcatcacaacagcctcagacttctggctatggcaacccataccagcccgcccctgcgcagggtggcagcggaacctatgctcctggcttcggggggttcatcaatgatcccaccgcgcagatgggattccaggtcggaaagaccgccatggcagctggacaggaatatatggagcagaacgtaagcagcagcttcaaggatgtctctaagatgaaagatgctaaccaggcatgaagttcaatcgctatgtctctataccagctctaaagcactatttcaacgtctcgaattcttacgtcctgaacaaattgtccctcgttctcttcccttggcggcacaaaccctggtcccgtcaacaggcgcgtcttacaacagcttcaactggtcccaatggccagatatcccagcagcagtactcttccatgttcctccctccgcgcgatgatctcaactctccagacatgtatatccccgtcatggcacttgtcacatacatccttctctcagcgatgttggccggattccgcggtaacttccatccggagctgcttggttcaattactactactgctatcgctgtcatactgttcgagataatgtgcttgaagctggccatgtacatcctcagcatcaacaacgagtcacagctgctggatttggtagcatattcgggatacaagtttgtcggcatcatcgtcactttgttgacatctgagatcctcactccgggccgaggaaccggcggctgggttggctgggtcgtcttcatttacaccttccttgctaatgccttctttctggtacgttcatggccatgtgcttttttgatgactgtactaatggtgcctcatagctccgttctctgaaatacgttctgctcccggactccacaagtgatgcatccatgcgcactggttctatgcacacggttgctcgctcgcagcgtaaccgtcgcacccagttcctgttcatctactcgtacgttatccagttcgtgttcatgtgggttttgagtcgggaggggccgatgtctatggcttctagtggtggagcaactggttcagcatagggtcatgtcggtaccgggttgcacataatgatatagacggacctcatgaaagggaatagggatattagttcatattcatgtacgctttgtggagagcagtataattgatttagattacaattttcttagatcagggatgtaattggtcacgtcgtgctcctgcattatgctaggacatgaagtcataccggatggacgatagctactggtgagacacggtcacaccagaacggtgcggggctatgcggtgttccagcaagtctacttttgtttacaagcactacaaatttctagaaacagtcacagatgattgatcacagaacatatattaaatttcaatatatctctagctaatgcctttatagcggcgcaatcggaagtcctataatcccacgttagcatttagtcaaacaggtaatgagtgacaaaattgcaggatgagatgctcctcagagatcttggtgatgaaggaaatttcattgccaaaggcatcaactactatctaggcgtgataaagttttttaatcactggagggggtgtgcaatcaaggaaatgcaatcgcaacgtaccgaaagagcgcgctgttggcaaggggagtcgagtggcatgaaagcgcaaacctgcttgatcttcgacatgttagcgatgagactccatgaggaagtatagtgtcaagataacaaggtagaaatgagaatatcagaatatgtaagaaattgaatatcatgcgtcagtgctgtatagaaaccccggcgagggcttcacagacactgggtcaatcgcaaattaccgcatcatgtgaggggggtatatattaaacaaggtaaaaggaaggagtaaagagcttaccagttaacgtgtggagagtcaagctccctggtggagttaagttagtaaacaagatggcggagtagttctggacagaacgacattttgttctgatgcaagatggcgaaaggtcgacagagtctggacctttacagttctgcaagatagcaagaggaacaagcaaagcagatcgggttgaaaacttgaagcttaaaagcaactccatcggagcggataatatccgacctccgatggagcgcgctaaggccgggaggcagccctaggccgcacgcaaacgcccctgggtgggctgctactggctgctaagcgagactcttgtgggcgaagggccgcagcaccgaaattcgctatccagcagaccagagcgacttgtgcgtttcggacgacttcgacaacccgacatttcgacaacaaattatcaacaccgtcctcccggagtctgtcgaccgtgagttgctgtccgcccttaccgtgatccccgcaagacttcaactaagacgtccctttttgctatttttctaggaagccttcgccatggccgatatcgatgttcaggttgctcaatggaagctggttgaggttggccgcgttgtgctgatccgcagcggtccttacaccggcaagctcgctgccattgttgagattgtcgaccacaagcgtgtacgtttttgcgcatataccggagttgctacgagcgcgaaggaatgggatttctattaggaggaaatgcgatattgacaaagagttccaccgattaggtcttggtcgacggtccctccaccgaggagcagaagatcgttccccgccacgtccttcctctctcccacgccaccctcactcacttcgtcatcccccgtttgccccgtgctgccggtactggccccgtgaagaagctttggcagaaggaggagatcgatggcaagtgggccaagtccaacttcgcccagaagaccgagcgcgctgagcgcaggaagaacctgtccgacttcgagcgcttcaaggtcctccgcctccggaagcaggtacgtttgcgaatcgcgatgatgtgacatgcacggaagattgggttatatggagaaatcatatgaaagtggtcgggactattggtcgattactggaaaagagccggggacactatgtgcatggagattgcaggaataggtgctgacattttggattcaacaggctcgctacgaggtccagaaggctcacgctaagctcagggcggctgctcctaagtcatagacggttcatgaggctcggtgcatagagtgacagggttgccttgggacggggttatttgctgaggtttaatttattttcagcaaaatgggctgtacgcattattgacagcataaaaatgattcaagaacctttgatatcctggcataggttatcctcgtacgtcatgaaagatggagggcggcacggaacgccttgcaattagtatatggcaaatggtatctcggggtattaatgatcttgacatgacctgctcatcacttagacaaaaaccaatccacaaacccaaacatttccccgtaaatcaaaacagtagtatttatacatggcaatgaattgctgcagataaaataaattaatgtagagggaacgcttgcgccagtagaagtggtggttgtacgatctgtagatgcatcgcttctgtgtgtccggggtgagggtcccaataagctcgctaacgattttcggcaggatgacattcacacagctttgcgacttcccaactacaacaaggcaaaaaaatccccctcatccaccacagccctttgttccgcgtctaggtaagttgaaatggaattccttgccgcgaagttcaattttacggtcgattttggcgatttcccgcagatttgtgggtgtaccacggtctgagagggacatcttcgaacctcccacatccagcaaccagtcacgtcccacagtgcgatttgctgaccatcaactctacagcccttctaggctcactcgatttacaaaatggccgacccccgtgttgaagagctccccgacgaggaggttcccaagaccaacgttgaggatgccggcagctcctccgagtctgaggctggcgatgagcccaccatccccggtggtgccgctgtcaccatccactctcgcaacgagaagaaggctcgcaaggccattggcaagctcggcctgaagcacgttcccggcatcactcgtgtcactctccgtcgtcccaagaacgtatgaatacggccctgtccctccttcccgtgcgacgcttaacaaaccctgcattcgtgcagttattgtgggcgacgaaggattttcagactgcagaggctaatctatcgcatatagatccttttcgtcatcaaccagcccgatgtctaccgttccccctccagcaacacctggatgtatgtgtctccatggactatgacgaattgatgaatcatatcaagcttacattgttgcgacagcatcttcggtgaggccaagatcgaggacctgaacgccaccgcccaggctaccgctgcccagcagcttgctgaggctgctgccaacgagcacgctggtcacgaccacgagcacgaccacggcaagggcaaggcccccgaggctgaggccaagaaggaggaggaagaggatgatggcgaggaggtcgatgagtctggtcttgaggctaaggacatcgaactggttatggcccaggctaatgtgtcccgcaagaaggccgtcaaggctctccgggagaacgacaacgatatcgtcaactccatcatggctctcagcatatgaacaccgccggaatgaacgcatgaatcggtggctggcgtctcttggccctgctggcaggatggattttgggtgcgaggtcagattgatatcccctaggatgcatgtactgtcaggccccatagtgtaaatcatttagccaaaagcagaattgaatgatgtgaagcactatttggaaccgccatttggtaggaatattttaaaataaaagtacacaaattcttccgcattgggagagttaatcaaattagaaaaacaaaaacctcggactataattgaaggtagtataaacatgtaagctctccggactatctatatccacgcccgcccctgcgaactcccttgtgtagtgccagttcgggaacacgggaaagccgtggtcacgtgatggcatccccattccaaatcttgccgagttcaaccctcaccctcccggaacctccagcttcgcacgttgaactcccctctctcccccaaccttctccgttccacatctcaaaatggccactgtatgtggggttcctgtttttgtcataacattgtctcggatggcgagagatatgtgtcagctaactgcttggtgtacagcgtagcgccgctctcaaggtcgactgggccaagttgaccagctccctcggactccgcggccagaccgctgcttccctccaggccttcaagaagcgtaacgacgatgcgcgccgcaaggttcagatcctgtctgagcaggcccagactgtcgacttcgagcactaccgcaaggtcctgaagaaccaggccatcgtcaacgagatcgagaaccacttcaagaacttcaagcccgccacctacgatgtcagccgccagctgaaggccatcgatgctttcgaggcccaggccgtcaagggcgctgaggagaccaagggcaaggttgagtccgagctccgcagtctccagaagaccctcgagaacattgagaccgcccgtcccttcgaggacctcactgttgtatgttatggtgtcccaggattggactacgcaggatcttggtacagatttattaatgtctctttttcttttccttttaggatgaggttgccgccgctcagcccgagatcgacgagaagaccgcctcccttgtctccaagggcagatggatgccggctggttacaaggtgcgtaatacaatacctgcattaatgcctaactctgcgacgagtaaaactaatggatgttggaattataggagcgcttcggcgacatgtccgttgtttaaacggttacatcttttgtacctattttacgtctctccgtccttcgaccagtataatcacacgaagttaccctttgttgtcaagcatgttggccagttaggatacccttgctctctggcagtgtgatgtcggttgtagggtcatgtatagaaacaatgttgaatttagatggttccctcaccaaccggaccgtttttgtatatcggccctcgaccgctatgttacgctccatataaagcagtcgactatatttaccattgaaggtacccagtacgcgcatttgactctttggggcaaataaattgtagcagttcgcaaggaaattgcgaatagtgggcgaccactgcagcgtgttatcgacactactccctgtcaactccgagaacagcaagatgataaaatcaggcatctctctggtttgctccccatattttccccagtctcaaggacgagttccttccgatcgaattgctgttcggtcttgattgccgcattgagcaaatagtttgtttgtcatggtcgtagtttgcaaggctctgggattagactcgagacttagccgatcccgaacagcctaaactctctgcgcgaacacgacacaggggatcctgcacttcatggctggctctggattgcacatccacgtcgtgatggatcaattatgagccacaaagccaaatcatcaaagtcagaggcttaagtttactgactgcgaacctatttgttatcggttcaatcaaattacgatctccactctgacagattcgcgcccctatttttgcttcgccaggaactcagctgggaaactggatggtctagaccataatttgatgaccactaaacaccgatggtcctgtcaaactacaagtacttaagttcaggatggtaagcttatcgccaatgaatgttgaagctcaggccatcctctcgaagtgccgtccctcaagactctatattatatatccctccagtatacggataattactagttgaaaggccattagtattcagttcacaatgcctaacgtctcgcagccggcccttgccggattatcagcactcgaaagactaccggtggaaatcatccaagaaatcttcctccactgtctcgaagttaatctcccgcgagcctccatacacatctcccgggctctttccaacacagtcctgtacacatgggtcactcgctatgtcttcagcagcaccaacgaaagctcaagacaagacttcttcacgcctgattttcttccctggcctcttgatgtttttgcactctctcccaatgaaaggagagacctgcaaaacgtcatcctcagttgtcgctggtgtacactacctttgatccgcaaatgccagagggaatacatagagcatacgatccgccgcaaatgtctgcagctagacttatcacctggagaccgccaggtcctcatcaatattggcgagcaattcgacaaagatttacctcttatgcctgatgaaacaccccatgctcatcgcggaaaaggcgacctgatcctcaaagccaaaatcccaaagtcagatgtggactgcaaagttgcagtgtggttcaatgctggcgcggtccagatccgtccatccagcgagatataccaggagactgacatcttccgcctaccatgcttcgcggccaatctaccagttcgggtcccggacaagctactttttcctccatggactgaatctaagctggacttcctcgagttgctctcgatggacggctatcttgacgaggatcccgagcatccgcgggcgaagcggatccttcgacagacgattcgagaccgtgacctcgcaacgtttaagcgattgctgagcatgcgtattcgtgtgccgtggtacaagtaccccattcggtggccggttcttccaaatcacttctacgtggctttgaagtatgcggatgaggtgaaggaccctttcgtcaggttgctggtgagtcagcgatgggaggatatcccatccgacgactttcagctcaaggatcaattgatggctaaacttgggacaggcatctcgggataagttgccaggatgacctcagtccgcaggacccacacgatatacccaactacggggtacacccaatttacttcgactcttatagtttggtgaaaatttcattgctcgaaatggaaacacaggatatcaggcaggacacaaaggacgagaaggaaacgcaaggaaccacaaaaactccgaactgatatccacattcatatccatatccgtcataacttcatggcgattaagtcaaggtcttggtcgaggtcgggcatgtctcgtatcgatcaatgtcagactcttgaccttcgcgttcttctcctcctcccaccacaggatccgcaggtcagacacgagataatcacgtcgaagagggtaacgacaccgtcgatgatggccttgcagacagcaccgattgtgttgacgatgcccatcaggcaagcgccgatggcgtggaagatactagtgatctatatatacatgtgttagccaatcaccagttcatttgttcataatataaagcaagagaagacgataaaagaagaagaaagacatacgcaagaaaccacagcacccatattgacgactcaacttatatttttccgtagttgtagcggtagtagtttcgaagcgaagtagtttgtatgaatgaacagaattatttcgatcccttcggcacggtagagttatagctcgaagaagcagtggtatgagtagaagtatcactgaaaggacgcatgttgatgaaagatatcgaaagtatcacacggggatatatatatatatgccgtgcagcgacaccaactgtaacacgttcaagtggaaagtacaagcgacgatcgatgatgtatgatgtctaacacaaagtacctagtggcttgcaacaagtgaaaggaagaaaaataatatgatcgacataacacctacatattaatatcccagttattctacggaccaactagtactatccttggaaccttcccactccatgccgtgctttcgttgcttcactgtgccttggatgccgtcataccgacgacgctgatgttctcccctccccttcccttcctgaaagggggaatttccggtgcggatcccacccccgtcaattattattacatttcatgtcacgttttggagtgacgacgggggctttgattcacgattagttgattgccacttatgataaggctgagctagacccttgacgttactgggttgctggtcttgatttttttcccctgcgaaattcacccaggggatgcgtgtgacgtcatgacttgtggtggccccccctggttccttgtggctggatgggggttagtgttagggttgagtggtgctggattgggaaggggtcaggtgagaggggaagccctgtggttgccttttttgggttgatatgggtggtttgctttgtttgatagctgaatatggatgttttgaagggaagtatggattacttgcttgatgctgtctacttgactgtctaaggttcaatgaaacgaatggcaattgtatgcatgcataatgtcattaaatatgaatctatttacctatgttatcttacacattaccatcaccgtgtcaataatctacacagcatccgcttcctctcgcactatccacacacccaagtatgcacattacatgttcgacaacaatctcaagatcccactcactctcccacccaatgtaatctggtatcccgtctccacgacacccttacacatctcccatgcgccggtgccgtcctgccgcgcaccatcacccttgcgaatagggtaatccactctgggcggaatcctcgtcgccataaccttagggaaccggtccacgcaaacagccttgatattgctgacacccctcaagccctcttcgcctgcgaaccgaccgtacccggatcccttgacgccaccgaacggcaattgaaccgcatagtagctgccaaagtcgttgaccgacaccatgcccgacttgatgttcgccacgcacttcgcaatatccgtctgattgtagccgaagacgctggcacccagtccgtagtctgttgagttggcgatggagatggcgtgggggacggaggaggcgcgcatcacgaggaagaccggagcgaagagctcctgctgggcgatcttcatggtcggcgtcacgtctaccaggagagtcggggtgaagtagtggcccagtgggtgttcggggtgctggaagcgctttccaccgcagattaggcgtgcgccttgcttgacggcatcggcgatgagggattctaggcggtcgaaggaggccggggagatcatggcgccgacgtcgggggttccggcggaggtttgggagtcgaggaggatggagccgagacgaaggcgagcgatacgggtggatacggtctcaacaagtttgtcgtatgcgttggggagggcgatgatgcgctctacgccgatacagttctggccggcggattggaagacaccacgcatgaggatcgaggcgatggcggggatttcgctgaccgtgcgcgagtcgtcaagaaccagggctgggtctttgccgcctagttcgacggtcacgggggtgagggatttggcggcggactcgcagactttgtgggcgacgggcttggaaccgatgaaggtcaattgggagatgtctgggtgagaggttaggtggtcggcgacgttagggaggcaaacgatgctctggacgaggtcgcgcgagtggccgcagctggagagcgctccgcggatgatctcgaggaagaaagcggaggaccacgcagtttgttcggagggcttcacaacgacaccgtttcctgcaaagatagcgctaatgaccggggagatgaagttgtggaaagggtagttccatgaaacacaggcagagacgacacctagaggctcgtaggtgaccatgttcttcttgtacatcatgaggaagtttgtcgggcgcgattccggtgccagggccttttcaccgtggtcaagtgtccatttgagcttctcagcggtgacgaggatctctccgaatgcagcatcgactttggttttgcctgaatccaagcagcaagcagttacgagttcatcttggtggtcgaggacgtatctgttggatgaagggatcaaggtcagtgcctgcgttggctggcgaaagttgaaatggtaagctgggtacgcacttcagcaacgtcctgaggaccttcctcctctctgcaaagctagtattggcccattcaagctgtgcgctcttcgcagccaggactgcgcgatcgacatcgtcaggagttgccggtttgattccattgccgagtactcttccatccgcggggcagtagctcataatcaagttgtcattccattgctgcgtaggagagagaaagttagaagcacttcgagataatatgggcgtagggtaaatcttgtaaaggaaagggcatcggtgaaatagaatgtaggcagacttactccccggacttgtccctccagcacttttcttccctctccttgaaggctgtcccacttctcgcccttccaattggcccgaatctctggagggataggcacgttaaacgaaacagcggcttccttcctgcccagaacgtagagatagccaaggtacgcggctgcgagcgagagcaacgtgacgccgagcaacggggcctgagtccggagatggcccaccagaggctggagagccggggggatgaattggtcgagtgagtccatggtgaaagtcgcacggggcgcttgactcaacggtttgcttgcccgggcccttctgggtgtgcaaaaagccagagagcgaaaagggaggaggggacttaaggactgtccggaggtggttcgatcgattatccactgctccgatatgcgggtgcacgtgccaagggggcgggttccatccagctttttgcagtatgtcaagagaggtttggaccattgtaatgacagggacgaataaattctatgctataagggtttcgagattattccaggtgcccttgcatgagagcactagtgctaaataattagatacggtgcctcaaactcggttgaaccagtacgtacctgtagtacaagtactaagtactatctctcaagatatatataagtagatgtaccaccatgactactaatactgagtagtcaacttactagtaactgtgatttgaactgaaatttattttcattagcaaaatctagctctacgttattcaagcaatgctaatactatctaataatcaacaacaaacgattccatacacagggaagagtcacacatggttcatgctgacattagaaacatctctgcttaagcacggcgtttccgcccattggatttggcatcctccgtcactgattctgtgccacctcccttcctctttcccgtcctttttaccagatgatcaatcacacagccctcctcccatccggcagatgactgcccagtaattgcccgacaccgtggacaagacttaccatgacggatgaggagctgatgaagggaatacttcaaatgatcaggaatgcgcacttcaagatggctgaacgccgtaatctccgttgctttgtccgaaggcacccagcccaaccacttgcatatacggaagatgtgagtatcaactgcaaagcaagggcgctgcaagcaaaagagcaacacacaagcagccgtcttcgggcctatacccgggtatttaaccaactccaccatggcgtcctctgtggcaaggctgtgaagatggttcagggataggaagtgctggtccgcgcatgcaatttcatattgcttgccaccttcggacttcttgatcagatcctgtggtgcgtcccgggaacccttcagcagcatgtctctgcgctgctgattctcttcgtagaccatgtctagtatagccttgatcttcttgctcttgatatccgctaagccgccacgtttgatggcttcaaagacatccttgagtggcgcctgacggacagcatcccaatccacgcttcctttaccgataccctctttcaggataccaaatctctgcacaagaccgttgaatgccatggcagagttgtttcctgttgttgctccgctgagcaacgtgcggatgagagcatcaaggaccgaaggaacctcgccacagccggtaacagtgagcgatggctccggaatagtggtaggtgcaacaatctctccgtgtacggtcgagagtaaccgattgacttcttcacattcttcaggggtgggacgagcccagtctgggaatggggtaattccaggtgtgaggccatatgtattagtctttttggatctcttctccttttcactggaccccgaggccgcttttgtggccttgtcgacagtgttctgcagggtgttggaaattgcatctatctcttctttctttataggggtgtcgcgggtgtctagcttaattggagcgctcttatcttgcagctcgggtagcagagtagccgaacctaaattgtgaggaagttcttgggcatcattattttgtgcatttctgcggttcgtctttgtcctcttggagacaggttcaccaactggcccgttgcgcttcgtgggtcgagtgtgactcgcagatgtagcggcggttgctcttctggccgagtctttgaaggctgcagcatccgagtctgataccttggatggctgggcctcgttctgctgcatctgagcagcaagtagcgctgtctcccgcgcagtggcggaacgtgtcatacgagccataactactcaatcaatgacatatagtggataaacggctgtgtactcttcacacacgatagaggcaaaaaagaagccgaccgacactttgaaatgccgcgcaattttgattcaaaccacggtgtataccgtcggctgaaggatgaggctagacagatactgcattacgcaaaagtcgccaaatcaaatcgatattgagtcaaccaccgtaattgttatgcaagagtctagaggttggtggccacgcgagacgatcaactgtcgtcacatgatcggggaacctgcagggccgttctgcatctacgtcatcctatcaaaaaaaaaagtctagttacacaagaattttcatcggtggtctatatattcgttaaactcagggtatctcagcccttcgttgtctttgttaaccagtcaagcaaatgacctccctatctatcgtccaccgtctacaaactccaagactccagaccacataaatgccataaaatggtttaaataggccataatgtcataatcatgcgtgatcagcaatgttatggatgctgatgtccatacgatccttcaccttgggatgctcctcctccttgtgtttgcgggtggtgcacacgctgacctggggcacctccgactcgctggggtcctgcgcggggatgatgttgcccgcgctatccagcttgacaccattggctgccatgcggaagtccttctcgctggcaaagccgtgggtgacagcttccttggcacggtccagcgccttgatcttgcgaccttcgcctcggagcttctccaggtgctcaaagtagccctcggagaccggggtgatgtagttgccgcagaagacaccgacttcaaagtcgtgtggctcagacaacccattctcctgagcgatctcagcacaggcacccttcaagtcatccaatgtctggtagatgacactgtcagcaccaatgtgcttggcgatagactcggtgtcgcggttgtgcgcgacgagctcggcaggcgaagccaggtcaataccatagatatgagcatgtctgtcaagatggtaagcaactgaaagatgttcaaactgggactgttgccacttacgtgatctctggggcgcaactggcaaagtagaccttcttagcaccggcttcccgggccatggtgacgatctcccgactagtcgtaccacgcacaatactatcatcaaccaaaaggacatttcggtccttgaattcggcctgcatagcattcaacttgcggcggacacccttctgtctggtcttctgctcaggcatgatgaatgtacggaagacatagcggttcttgacgaaaccttggcagtaaggcttgtccagataccgggcaacggccgccgcagacgtcgtagaggtctcggggatggggataacgacatcgatatccttgaccacttccggtccaaggacattgaggattctggcagcgagacggtcacccatccgctgacgactacggtacacgctgataccgtcaataacggagtcaggacgagcaaagtagacatattcgaagatgtcaggagcataggacttcttgggagcgacctgacggaagacaggctcacagcccttctcgatgatgaccgcctcaccaggctgaatgtcgcggatgttgctgaatccaagctggtgaagggcgaccgactcggacgccatcatgtaatcggtgccctcaccgtcaagggaggcccgagaaccgaggacgagaggacggataccataggagtcacggaaacccagaagaccgaagcccgcaagcatagcagtgcaagcccagccaccctggcatctctcatacatgcgactgagactggcgaagaggtcttccgtgttgacacgggccttcttcgtctcgctcagctcgtcagcccagatgttcagcatcaactcactgtcgctgtcagtgttgatgtgacggtgggcttcgatgtcgagatatctcttcagctcgggagcgttgatcaggttgccattgtgagccaggcagataccatatggactgttcacatagaatggctgagcctcggcgttggcactgcttccggcagtaggatatctcagatgaccaattcccatagaacccggcaggtctgctaccctggcgccatcattgaagaccttggccgccataccgttcgacttcaactgatagatgcgaccgccggttgcgcatgtggcaattcctgctgcatcctgacctctgtctaatcacgtaaagacgaatattagttgggtgtgtttcagaaagttgacagtctttgcattctggggctaaactcacgttgaagcaggtaaagtgcctcatgaaggtcgatggcagcggacgacgaggggttcgcctgaatcagagcaatgataccacacattatgtcggcggtaggatgttctagttggaagcttgagattagcacgtgcttccccaaagaaatgatgagcaaagcaaaatttcagtggcaatgtaagtctagtcagatcggaaaatatccgcaatgatgcttaggaagtctaacatctataaaaaaaaaccgaaattcatcatagaaaggacgaggattgaacaagaaagggaggatgaagaaagcgatcctatactcacatccagaacgggtagagaaagacttggggacacacacacacagtgtggtggggtaaaaaacggaattggacgggtgtaaaaagatgggatagagccggaaacgtctatcgagacataacaagactcatgcaaaggtagtaatggtggcggatgatggccaatgtcacgcccacggagggataagtgaagcgaataacatggttaaaggagtttttttaggagaggaagagaggagagagacgcctcgcatcttatttctcctgttcttctccactgccaaccgagtaaaagggaagaatttttgcgggtgccgctaaaccaaagaaaatttcacaaaccggagattgccccggctttccagtaatgccgatgccggacctgactcagctccccgcccgttcctgccattggttgatccatgctttgctggtctcgaccactcagagatgagtgtgttgattaggtaagtgttatctatataatttcgtagtagatactaagtactactagtatagacatactagaattactctagcacaggctattgccgttattttgctaatgccaactcggaatattcctgccacaatgctgatctgcctagactcttgtggctgctacctagtcactcaatcttactgaactggggttgtgagacctgggtgagggagctgtgtagccaatgtgatgcaagactagcaatcagccataatgtacttcacagctcattcacaagtcaggtgcttctctgttatacctcggaatagcttcatgttatcaaccctatatgacccatgcagctacctaacgttcacatcctcacgcacttctcactctcctttgccctcctccacttcttgaccctgtcaaccgtagcaattctccccctcgtagccaatcagactctccattcactctcccatcccctcagttcggtgcctctcatctgccataacgtgtgcaaagcgtgttattgttcacgaggttgtctatccaaactcttctcatgggttactcgctcttcacacttccttcaagccgccttttcctgcccattcctctgcctataaagatgccttctcttctcttccaactttctctcctctgcatcttcctcctctacatttctccctccttctcgcaagttttctgtcttctctatcatattctcgcccattcaacaccgttttatctgcaaggatattcttctatctatcttctccttctacttatctatctgtcatctacaatggctccattctccttttccatgcctcacctctgcgaaagcgacaacgattggccctccgatcttatgtctatcgatgaaagctcggatcacagcagcgtaacggtagaaaatgacccagaccgggtgttgaacatccagacgggaattcgatcaggccctctttttgaaaacaatcctacacccgctgagttcgatgaaattattgagctcgactcagacactgaggagggcttcaatgaacaagactacctgaccgacgctgcgttcaatcggctactacaaaactggcacagagccccccaaggacaagatgctgatgccgaggtgcagttcattgatgtccaaccagccaagcgtcctctaacagaatggtgcgcgaatggcattgtctacacaccggggcaatccctagaaatttttgatggaaattttatccggatagagagcatatcccagcacgttgtgtctaaggagatcttcttcaatgggaggcacttattgcgtgctaccaaccacaagggcacatatatccccaagtggcccaacgagctcatttggatagcaaatgagaaaagaaatatcggactgccattgattaagcgcattgtaaatatcactttcacgaatacctgccatgtggagcatgatccccggaagaagcagcgtcctcacggtctgttctgcaggctgaaggagaactaccgcctgaagccagatgatccagcatcagttgaatacatctccttcgaggaggcagatgaagggtatagggctcatcccagcagtctacgcaaggcgtggagaggaactacccgtccttttggagcgagtgatgccccgcaggccatcgatctcgagggacctgtaattgatctgactggacaaagtaccgacgataaaagcagtcggcagtacacgtttggagacggcttctgcggtgctggcggagtgtcctgcggcgctctcaaagctggtttgcgtccaacctgggcatttgataattccagacacgcgataaatacctaccgtctcaatttccgtgatgccgagtgcgaagactcggatgtcttcacctttttgacgaacgattatgcgtttctcaaagttgatgttacgcatgggtctccgccatgccaaaccttttccccagctaagaccatacagtgcgctacagacgatgcaaattccgcatgcatcttttcgtgcgccgagatgattcggaaagcaaagccgagggtacatacgatggaagaaacaagtgggttgtacgagcggcatcgagagacatttcaccgtgtggttcaggattttattgaaatcggttactctgtgcggtggacaattctgaaatgtgcagattatggagtgccacagctgcgacgacgattggtaatcattgcatctgggtcagtagacattgtgtgtctttcttgtttactttgactgatggcctttgtagccctggagagacactcccaccgtttcctgaagcaacgcatgggctacctggttccggcctcagggactacgtgacgattaaccaggtcatttcacgcatcccccgcggagcccctgaccacgatgtcgaaggcgcgctgcaacgtagcgcgattgaccgaagaccttttaacgccaacagacaggcacgaactattacctgtggcggcggcgagaattatcacccctcgggccgacgaggcttcaccaacagggagtttgcgtgcctgcagactttccctatgcgtttccgcttcgggcctcgcgaggtacgaaaacaaattggcaacgcagtgccgccgaagttggcagaagctatttatcgtagtgtgaaagcctcgctgcagcgaacagatgaggaggagacaaatcttcagcggcgagggctacactaatcttggtataaccatcgcctcgtcttttgtgcatcttgtgcggacttcgtatgcacttttttgtttattcttcttgtcggattgtcaaatcaatggcttcaattagaatattcctcgattagaacatcatcacaatgagtctcgtttcttgtttactttgagaacctgtgtatcttatgttatttcttttcacagtgagtttggaaagtattggcgggcttgcgttgtgttcggccctcggtgtggaattcgggtaccctcagtgagtggagtccgactgtcagagctccgaggggggaagatggggatgatctgccaggagatccacatgcctttgcctcaatttgatagccgcgggaaggcatgaagccgtccaaccgcggagagaagggcgcagccgtcgccacgatcggggacgggttctggtgggaggacgttggaaatgttagaggagcgagatgaattgctgataatagattttgcttcaagatgatctcaattgtgcgttggagatgcaggatccggtcgtcgtaggtcatgcaaggtggcacctcctgcatgatactaaagcactagttctcgaccgggcattctgaagttgagacggaggggcccagccaacattattagcattggattcacagtgatgagggcgttcaagaggagaaaactctgggtcaggcaccggtcgcactgaaactggtttttgagcgccattgactttctgaatattgggaccacgcgaaaaggcgccgattgacttctccgatcaaaggagtatgaggattgatgggaatccctccccgcttcgtgtgtctccggccagccggcaataaccgcccgattgattataggaggagggaataatggcctcggttcaacgccggggggcggtatgagatcagggtgactttagctcaccgtccctttccttttcccttcttcccttggattgcccccagcaacgtaagtctaaatactactactttactcatcccccccattttctccgtgctttccgccctgtctttctttcttctccttctctccctctccaattcggcggcattgctgcatcctcctccattcattgcatcgtcttgggtatcatcatgtctgcctcttgttcagcgttgagacggctgacccacaggtctccccgcacttggccctcccgcatctcctccgtctccaggcctgcatcttctctttcctccgttgctcgtccgagtcgcagcacaccctcaactttttctcacatctctcgattttccaccatgtctccccttcaacatgctgctcccgtcgttcccggcgataagccgtacgacccagagatcaaggatatggccgactatatccacaactacaatgtgaactcggacttggcggtacgagggttctcccatgttttgattgactttcttctgtgtgcgatggactaattgaagacatcctgacttttagtatgacaccgcccgtttggtgttcctcgacactctggggtgcggtttggaggcattgaagttcaaggaatgctccaagctcctgggcccggtggtggacggcaccgtggtgcccaacggaactcgcgttcctggaacgccctaccagctggaccctgtcaacggcgctttcaacattggcgctatgatccgctggctggactacaacgactgctggttggctgctgaatggggtcacccctcggacaacctgggtggaatccttgctgtcgccgactgggtttctcgcacaaaccgtgcgggcggaaacattgccaacggcaagatcttcaaggtcaaggacgtcctggaggccatgatcaaggcgcacgagattcagggtgtgttggcgctggagaactccttcaacaaggtcggcttggaccacgtcgttctcgtcaaggttgctaccactgctgtcgttgcaaagatgctcggccttagcgagaagcagaccgcagatgcgattacccaagcattcgtggacggacagtctctccgtacctacagacactcccccaacaccatgtcgaggaagtcctgggctgcgggtgacgcatgccagcgggccgtgaacctcgtcttgaaggtgcagaagggcgagggtggcctgcacaccgtcctgtctgctcccgtttggggtttctatgatgtcctgttcaagggcaacaagttccagttccagcgcccctacggtagttatgtcatggagaatgttctgttcaaggtctcctacccgggtaagtctagcatcagacgtcagtatggagggaatactaacagttgccatgatagccgagttccactcccagaccgcgatcgaggccgctgagatggttaacgtgaagctcaaggctctcggaaagactgccgccgacattaaggagatcagaaaccgcacccacgaggcgtgcattcgtatcatcgacaagcagttcaaggcgatggacaacttcgccgatcgtgaccactgtgttcaggtaggtcctgccgtatccaaaatttgagtgtcatgcaccacgcatactgacaaccgcgccagtacatggttgcgaccatgttggtcttcaaccggttgactgccaacgactacgccgacggatcggaggctgctacttctcagctcctggaagacctgcgcaagcgcatttactgtgtcgaggatccccagttcactaaggattaccacgaccctgcgaagcgcaccatccccaacgcccttaccgttactctgaatgacggaacggtgctggatgaggtggttgtcgaggcacccttgggccaccgcctgcggcgtgaggaggccaagccggagattctggccaagtacaagcgtcatctgcaggcgcactttgaccaggcccgcattgaccagctgattcaggttggctgggaccaggccgctcttgagggctacgacgttgaccagtacgtcgacttgtatgtcaaggaccagatggtggcagctcagtagagtcatgattgtatatgcggcatggagaaattataccataatcagaagcgagactttggagacatcgtgtatgagattaacgagaattagccactgatagaatacattgaattaccatatggtgggacagcgataatcaggattctgcaggcaggaggaatgaatagaggtcgggctaggatactagtggatggcctcgctgccgacggttacgcgacacgctgccgaacccgccaacaacaagatccatgtttatcagtcaggatcaagagcttgccgaccctccctatgttatcatcttgcagagtagtcgagctagtagatttccccatacagacaacagctgatatcatccctacagaatatactcatccaagggcagcacataccagatcgtttggcctacttctgagtctgttgctatgggagatttactatttcctctacttcataattcacagactagtactaaaagcacatagcaagctggcatatggccccagtcctttagttgcatcaagaaccatgtcaaattagaaagataaccttcctcatcatctccccacccaaaccaccaccgataggatatcggcgataaggaaggccccaatatctatctacgtactgcctagagcagcaacagtgccgcgttggtggctgtctcaccgcaccaccaatcatatcaacaccgaacctgctatcagcgcagcgcacggattccccaacccgctagcctaatgcaggctcgataagaagcgaaaacctggggtaaagacagtactaagacactatctcggcatcggctgttgtcgatcgggacagccttgccgatacagccaatgatcgtgttagtggggagagttgcaacgaggatactgagttcatgccaagatgagggccgataggatgctgaggggaattgcattccatctggactgcttgttgggatgtatatagggaagtttatacgcgccatgttgtgcttgtgttggtatttgcttggatactgccatcgtctctcaataccatgacagagtttacgactgaaaagaaggaggagtgcggtggtgatcatgaggctgtgaagacaagttttgataatggagttattgaattggagtcgatgcctcagttttctgctgaggcggagaagaggcttgtgaggaagattgattttcggtatgcatgctttgaatctgccccatgggagtgaggagagttaacggtgacccaggattcttcctatcatgctggtcgcgtatatgatgtcgtttgtggataagcagacgttgaattactctgctattatgggtcttttgactgacctgaagctgcatggtacggagtatagttggacctcgtcgatattttattttgggtatcttgcgtttaggtaagttgactaccacatgaagtataggctgagtgagcactgtctgataagttgcattcagttatcccgcatcactgcttctcgtcaagttccccttgggaaaatacctagcgtgcacatagtatgtctcctcttcctgacaccaccaaaccacacgcttatagctatagtctctgctgggccgttgtcctcgcatgtcatgctgctactacaaatttcaccgggctcatggtcgcccggttcttcctaggctgcgcagaagccagcgtgaccccgggattcggcctactcacgtctctatggtatcgcacgtccgaacaacctcttcgccacgggatctggttctgcggcaatagtttgtcattggtgcttgggaatgccattgctgtgggtatctggcagatcaaagacagcttagcgtcatggaaggtagagcccttacagattttctcatcttgacacaaatctgatatctaacagtggatgttcatcatcttcggcatcgtcacattcctttggggcttcctaatgctccttcgactgcccgactcacccacaaatgcttctttcctaacagacgaggagagggtcattgccctggcacgactgaaggcaaacaaagccggttacaagaacaataagattgaatgggatcaagtcatcgaagcgttcacagacccgaagacctggtttttggctgtgtttgttctgggttgcaatatccccaatgggggctatacgacggtgagtctttcatctttgtgagtagatatgcgcgactaaagagatgatacatagttctccggtctcatcctcaagggcttcggatacgacaccgaacataccctgttactgggcatgcccggaggattcatcgtcttcctcatcatcctgatatcgtatgacctatccctattattcattatcctgactacaaagtccatcctctaaaattatacattattacagctgcttcacctcgaccaaaatctccaatagccgctgcataacctccatcatactctcttgcgtcaggtacacctcaccccctctccaacccctgctatcacactaaccaaaagcaaagtatcctaggaaccgccctcgtcaacagcaccaccaccatcgcatcccgctacatcggcctcattctcatgagcctctactccgtcagcctccccctctcgttggccatgatcagcgccaacatcggcggcatcaccaagcgagccaccgtcagcgccatatactttatcatgtattgcgtggggaatattatcgggccgcagctgttctttgagagtcaggcgccgaggtatcaggtgtgtttcccaattactcgttctccaattgcgtggccctattgaaagtatgtgactgatcttgtgttttatggtggattagagtggatttatagccgtgtttgtgtgtttggccgttgtggtagtggatcttgcggcgtttgttgtgtatttgaggtgggagaatgcgaggagggataggttgggaacggggatggggatgagggagggagaggagagggaggtgttggctgatgtcacggatttgaagaacccggggtttaggtatgtttattgattatgatcgatagtaggattctcttggggtagcgtggactactacttagtacatgatgaatcatgatgtgggttctatttctctaaatgcagtcactgcactgattttgtacaatcaagtactactcctgatacttctgagagcaactgctctctagaccgagatcgcagacgactaagcaattacctagttattcacagggcatctatctttactactagatataatggtcaggtttacctttcaattactgtagagggagataaatcctgctatcgtgcatacaaacatccagcatccagcaatcatcatttcataacaaatacttcatactcattcaataattaaacagcaccattagactaatccatcgcaaaaacaatctactcctccgcctccacctgaaaatcctctttgaccctcctcgcaaagtcatcatccgtcacaatctgacaggccacaacagccatccccgccgcacaggccaaacagcgctgatgcgcctcaggggacccagcaccattggtgaaccccggggtatgattgacgccatctgtcgggatggtgaagaggccatggaatccagggacggcgtaggagacgtttcctatatttaccacagttaataaatctgatctatcaatgagatagatatctaggttgcgagctgacgtacccatatccgtagacgccccggtaagtttaccagactgcccggcgttattcatcacagtgtgatgacccattgcgcgcataacagagacgtagctctcgcagatgggattgttggttttaaggtcgtcgtatgagacgcccctaaaccgtcgcatcacaacattagtactattccatgagatttgaatgagggttcagataactcaccactcaaactgcaccccacagcccgtggccatcgccgccgcctcaaaacacttaaccaccttctccgtcagcgtcttcagacccttcttcgtcggcgaccgaatgtaataatccaccgacgccgacataggaataacattcggcctatccccgccactagccacaacaccatgaatcctctgcgtcggcaggatctgctgcctcaacagagagatattcacatacgccgcgaccaccgcatccagagcattcacgccctcccacggcgctgcggccgcatgcgccggcttgcccgtgaacgtcacggtgactttatcattcgctagaaacccgcccggtaggaccgtcgccaagctcagcagctcgggatggcccggggccatggggatagggtggaccatcaagcaggcgtcgacatccttgtaggcaccattctcgaggagacggactttcccgccgccggattcttcggcgggggtgccgaggaggcggacggtgtagttagagtcaggggcttggtgtttgagggcctcgcaggtggcgatgaaggcggcaatggagctcgtcgcgatgaggttgtggccgcaggcgtggccgatgttagggagagcgtcgtattcggcgttgaagacgatgttgcggcccccggtgccgtgggtgtaggttacttccaaggcggtttcgaggccgtaggcggagcgttggacgtggtaggctgggttggtgcgttggagggtttcgaagagcttgcagatgttgtcgtgggcttggtgttctgtgtaggctagttcgggggtggaccagatctggggctgttagtaagtatgtctgtgttggggtgggttggaaagggaagcttgccttcttgttgatgttttctagctcggaggcatgcttgtggagggcttcttcgacgctcgtgatgaagcgttgttgtgttgcttcgagctgcatggttgttcgtatttactaagtaaaggtctggctagattgtatcaatcaagtaccagaattggaaactggcatgtacggcaatttatagctggatcgtgcatggtggagatgaatctccgcattgattgcggagatccgagagggggctatcagtatcagagcgataagcgataggaaggaacctaatctactactagactatctactactgcttttggtactcttgaagccatcgcgattgccgataccgaggtcacatgactggtgccgagccagccaatcggcgggcgaggctcggcaggatggcggcttgagggaaaaacgagcatcggttggcgattcaattctccgcagttcctctttcccctctcctttctatgtcctcttggttggtttgtctcggctcggtgtctctaatggccctgcttcgaccaggttacatgtcaagtctgacaggacattcctccccgacaggcacaccgcgagcaagtggagcaacggcaagcacgcgatagaaccgatagacgatgcatgggctcggcaggaggactcggtccaagactggtaaggatccccaccagttctgtcttacacaaattgtctaggttgctttttttgtcccagaacggtcggacttactgcaccataggttgtcgcacgtgtagaattcgcaaggtcaaatgcgacgaagaaaaactattcgttcccggtcaggaggagccacaatgccggcgttgcacagcggcccggatcgtatgtgagtggaagggcggccccatcccccggggtccagcaaaaaggcccggaaaagaccctcgctcggtggaagcgcagatggtccgtcagtctgttccgtctcctgcacgctctttatcgcccaccggggctgctgggaatagcattcaagcggccaattcccttgttatatcggactttgatcgctcgtgcttgaattatcttcaggattccgcgctggtcgtgatcctcggaaagcattggccatggtctacagtctcttatgcataccacaaaatcgcagttaaagaacccatggtcatgagcatgatgttggcgactacatctagtgagatcaaccggtcgcgtctgtacgaccgggacaagacggagggaccatgtactattgagagcctgtccgacatggacagtagattgcactatggtcgggctctctctggcctccgggaagcgctgaaaccagacgtcaagcccccggagcagatcgaagccatcttcatcaccttgtggatgatgattgactatgagaaccgattcggcagcgggactgctggaatcaatattcacattcgcggaatcgagagtctactcttcaaccacgtcgtcccatcactcaaacaaatagggcctccagatatcgcaattgcagaagcaagttcaaagactgcactatgtcatgtcacagacgaggcccagggcacgagcgcatgtgacagccctgggccgcaacagactgccgaattgtccaagaataggcttcgacatacagcggtccctctttttctgctttggactttgtactttttcacaccgggcgctttgctctctggcccaggcgctgcaaggctcgatgccgacctcttccggtttttcatgaaagaggaagcaggaagtgtgggattgagtctttccgagctatacaggattggcagacagtcaccgtctcgattctggggggattcctaccccaccacagcccagctggatgatatggagaatatgcccgggctatcgctgtatcatcgaagtcatgtactgcaattcaagattacggagttatttcggcaaggaagtcattcggtcacgacgggtcttgagatcattagtgaactcaacatgttatctgatgtaagttcccgtcttagtcctgcagatgacctgtcatttatcttcatatggatggtgacggcgactaatccgctgatcaggaatacgataccttgttgggttccgccaagtctgcgccctcgtgtgaaatcgtgggtgacggacgtcgcgtgatggaaacgatcttttgggcagccattacttactacggcacgatcgtgtacttccacctgtgcttcaaagacaccctggccaaaggtatgcagggtgcagggatgatgactctgcatgatgccgtttcccaggttctggaactctctttgaagctacatcgcagcagaccgcacttgatggtgcgcatcacgtggcctctcttcatcgcggggatagccacatctgacaggatctaccaagactgggtgtcgtttcggctgcgcgagcttggtcgctatgggctcaactacagccgggtcagcgcccggtttgacgagatcatccaaggaggcgatccctttgcgcacggacgaaggccattgtgcgcgcagtagtgcaattcggcaagacgttgaagtgagttgataggatatctggatcccagtggtgacgacgataaggccaggatagcccggggatctgcttgacgtgtggttctagaaagtttcgggaaggggatcctagccaaatcgtggggacttcccagactgccaacatctgctacactctagacgtgcagctagtggtcgtacattatcgcgctcattcagggtctgccatgcataacgactatgcttggttctaaaggtgacatcgtggtcatggtgacgaccctattcgaacgagtcaaacgggcatggacgggcttagagtttgccaaccatagcgctagtcttggcaaagatatacacggaaacaaaggactatccattgcggtcactggctatctgcaatgttgtagcgggctattcgctgaaataagatgtttgacaaatcgggcatctatactgatggtattcgaaccatgatgcgagacaggacgcatgaaagacatggtggcaacggttaaggaccaggatgtttctccgcccagacactcgatcggcctccatcgcgtcatgcaggctgggttcgtcgtggggtgatggtgcgacccaggccggctcgggaaaaggaagggtatcttgggacgctgctagggttgacagacatatgggactaccaaggaagccatgcgtcagttctatggaacgcaagtccggccaagaccgctaccagcagtgtgtccccgcatctcggccaagcgttggcgccacccaaaggagaacagccttaccaggattcctgagcgtatagccggtcctcgcagctcgcgtgtgtctgctcgtccagccatcgatcgaccgatacctgccgcattatgccgccatcggtgaggttgcggagttcgctactgcgtctggcagttgctcgtcgacgatgatggtacaacacgatactgacaggttagagatacgtctaaacaatggagttcaatcagcgtgcagcatctccaccaggcatgcatgcagcagttgagcttccaataggggacactggaacactagcacttacaatgggatcgtactcaaggccgcaaacaacaccacagcaccaacgatgacacccactattccggtgtggtgcgtatccccagccatcggaagtatacggaaaaaaacaacaaagataagatcgataggtcaactgcgcttaggagatgacgcgtcggataaatcggctcgaagccagcgactcactcctcacgacagcctccaaacagcatcagcatcagcatcagcaggggaaagttggtggggatggtcgcatgggagggggggatactgggaataggatccattaccggcgggggaattggggcaggtctccgaggacagcgacggctgcatttaaagttgagccagcgagtggccctcagacccccgcgcagcagcacgccaaggccaccggacagacaccctgggatgcaggccatccgaggcgggccaatcctcaggatttttgcctcaggagacgccaagtctccgcgctccggaacaccttggcgtttccgctggggccactgggccgctgcaccaatcacatcgctccgtctcaggtctcggtgctcgtactggctcacgtggcggaatgctgttgtcgtatgcgtcataatccccaaagaggcgagactcgccgacttcgcgcccaaggttggcgccaaggcatcgcttccgggggttctgtgattggcgcttggcgggctgggcagtctgctcggccttgggtgtctatcttccatgccaagactgcttcccaggtccggcgatagaggaagcaacttataagaaggaggaattccccggaatcatgtcgaggagagagagtttagaatttggaaataagaagcagaatcaggatctagaccagttcagatcagatcaatctagtgctttgcctcaagtgtatggactctcattccatagaggatacaatctacatgacacctccgtgatctcctacctttcagtagagaaaccctcaagcactgcatacacagacacacagacacaagaaacacacagataccccaatatgggcactgagaaacagtctcagactgcctctaccccctcccactcccctctctccgcccccgcccacacccttccctatgcctccgtcttgcaagagctttctgtcaattcagaagaaggtctcagcacccaagaagcacaatcccgacttcagaaatgggggcccaacgaactcgagggagacgaaggcatctccctcgccaagatcatcattcgccaggtggcaaacgccatgatgctggtaagttacccaactgctactaccattaactttgttctcgctaacaaggtcattactacccaggttctcatcattgccatggccgtcagtttcggcattgaatcctggatcgaaggcggagtcatcggggccgttatcgccctgaacatcatcgtaggcgtctatcaggactacgccgccgagaagaccatggactcgctacgaggcctcagttcacccacgggtgtcgtcactcgtgacggcaagaccggtaccattcccgccatggagatcgtcgtgggcgatatggtcgatttgaaagtcggagatacggttccggctgatttacggtatgttccgcccatccctccacatatagaatccaaagctaacgccacctagactagttgagacaatgaacttcgaaacagatgaagccctcctcacgggcgaatcccttcccgtcactaagtcatcgactactaccttccccgctgacactggacccggcgatcgtctcaacatcgcctacagctcctctactgtcacccgtggacgtgcacgtggtgtggtgatcagcaccggcatgaaaactgagatcggtgcgattgccgcggcacttcgtgagaatggaaaccagcggcgccggcctgtccgtcgtggtcctgaaggcgaaaccaagaagcggtggtatgtggtggcctggacgttgacatgcacagatgcagtgggtcggttcttgggaatcaacgtggggacgccgctacagcggaaactgagcaagctggcgctgctgttgtttggaattgcagtggtattcgcagtgattgtgatgggcgccaacgacatgcgcgatgacaaagaagtgatcatctatgcagtagctaccgggttggccatgatccccgcttgtctagtggtcgtgttgacagtcactatggccatgggcacgaagcagatggtcgagaggaacgtcattgtacggaagatggattccctcgaggcgttgggcgccgtgacgaacatctgctccgacaagacgggcaccctcacccaaggacgcatggtggccaagaaggcctgggtgccggggctgggtaccgtgtcagtcggagtctcccgcgacccattggatccgaacgacggcgagctcaaggtcagcgatgccatgcccggagaaggtgaaggggaaggcgacacgaagacgccgcaagagatagtgaccgacagtgccttgctgcagcgctatctggacgtcgcagccatggccaacctggcccatgtgcaccgctccgaagagaacggacaatggcaagcccgtggcgagcccaccgacatcgccatccaggtcttcgcggcacgcttcgactggggccgggaaagatggactaccggtgacaagcccgtctggacacaacaggccgagtaccccttcgactcgaccatcaagaagatgtccgtgatcttccgccgggacgacacagacgtgatcttcaccaagggtgccgtggaacgcgtcctcgaagcctgcacttccatcgtctggaacacagacacctccgaacccgtgcccctgaccgatgacatccgcaacaccatcctacagaacatggaagcgctggctcgcgaaggactgcgcgtgcttgcactcgcccaccgcactagctcctccaccttcaccgacgtcccgccccgggacactgtcgaacaggacctcaccttcgccggactgatcgggctctacgacccccctcgtccggagaccgcaggggccatcgaagaatgccaccgcgccggcatctccgtgcatatggtgacgggcgactacccaggcaccgcccgagccatcgccgcccaagtcggcatcatccccgccaacgcacagctcctctcgcgcgacgtggccgataacctcgtcatgacagccagtcagttcgacgcgctcagcgagtccgaaatcgacgccctgcccaccctccccgccgtgattgcgcgctgtgccccgcacaccaaagtgcggatgatcgaggcgttgcaccgccgcggccggtacgccgcgatgacaggcgacggcgtgaacgactcgccgtcgttgaagcgggcagacgtgggaatcgcaatgggccaagcgggcagcgacgtggcgaaagatgcatccgagctggtcctaacagacgacaacttcgcaagtatcatcaacggtatcgaagagggccgtcgcatcttcgacaatatccagaaattcgtcctgcatctactcgcagagaacgtaggcttagcgctcaccctattgatcggcctggtattcaaagacgagaatggccagagtgtgttccctattgcaccggtggagatcctctggattatcatgatcacgtccggattgcctgatatcggactgggaatggagatggcggcgagtgatgtgatggatagaccgccgcagagtgtacgccccctccctcctcttttctctattgcatgtaatactaacgaagatatgaaatagaaaaacggcatcttcacccccgaaatcatcctcgacacgctcgtctacggcatctggatggctgccctgtgcctcagcgccttcaccctggtcctcttcgcctggggcgacggcaacctcgccacagaatgcaacagcagctactccgatccctgcgacacggtattccgcgcccgcgccaccaccttcgtctgcatgacctggttcgcgctcctcctggcctgggagatgatgcatttgcgacggagtctattcaacatgcacgactcatcccccaccaacaactctaaacctagaaataagtggacgggatgggtctccgacatctaccgcaacaagtacctcttctggggcatcgtgataggattcgtgctcacctttcccgtgctgtatattcctgtcattaatgatgtggtgtttaagcatattgggattgggtgggagtggggggtggtgtttgttgaggccgggttgtttttggggggtgtcgaggggtggaagtgggtgaagagggtggttgttaggaggtatttggcgaagaggggggatgatgggaggggggcgatccatggtgttggtgggagaaatggggtggatgaggagaaggtcgctgggggatttagtcggtttacgacgttgagtcgggaggagggggttttggggttgaagaagatttaaatagaccctttcttttgtggttgggatggtgtttatagactatgtttgatgtgatagattattagaacgtgatttggtttacctacgttggtacatgtggttacgagtatataacctgcgtttgaaaagaaactcgaaatcattaattcatatatcgtagtatggctatacttaatgccccaggttctgaggagcgacagtggccgggccctctggagtaacatacgcctattccaaccggttagtagtgatcaaacagagttaacgggcgtgcataccttggacattccaccatccacaacaaagtcactaccattgacgaaactgctctcgtcactagccaaaaacaccacggcatgagcctgctcaatagcctctccgaaccgaccagtggggaagtgcacctcccgccggaagcgcttgggcttgtcgtcacccaaccagtcttgcaggaggggagtgctataatcatgtcagtaacatacccacattgacagaacacatcacgagatccaagaggggataaactaacttcaacggcgccggacacagcgcattgaaccggaatccctctctcgcatgcacaatagccagttcacgcgtcaacgccaacacagcacccttactagccgtgtacgccaactgaggcgtagcacttcccaccaaggccaccacactcgccgtgttgatgatgctgcccttggtcttcttgtgacgacgcagactcagcacggcatgcttgcatccgaaccacacacccttgacgttgatgttctgcgtcatatcccaaatcttctcgggggtatcgacggcgtcggcatcgtcggcgtgcatgatgcccgcattgttgaagatgacgtccgtgccgccccagctgtcctgggactcaaccatggcttgtacgtcggattccttggagacgtcgcatttgatggtttcgacgcggggagcggtgggaacgacttccttgactttggcgagggctttttcgagggctggggccgagatgtcggccattaggatgttggcgccttcgcgggcgaagaggatgctggtttcgaggccgataccgctgggttggttagcgggtggggagggattgagaattgagattggtctaaattacccagctgcaccggtgatgatggcattcttgccttggagacgacctctaggagcggatgccatgattctggggttgggttagctatgatggtggatagtggggattggtgcggggtagagtagatggcagttgggtgatggtgtgggattggcgtacttttggatatttctgatatatttagagtatgatcaattgagtagaaaggcaattgaagtagtaccagcgagaacaaggagaacacactggaaagatgagtagagagagatatgcaagagaagcagggatgaagcaggaatgcgggacagtggagcccgcttatctaatggcgatcccgataaggcaggcagctgtcaggcacgcaggccaccatgcatgctgcatctgctcgtgtgccggtttgagactggttgaattggtatcattcatggtaaaatagaccctgtatctgtcgcaattggacaagacagatgataagaactgcaagcatcccaatcattgtggcttcagtatcagcctggcgggccccgtgacggctccccagctgataagcagcggtggctgacgtacggccgtccttgcgtcccacttgcctcctcaccgtcatccccctcatcccccaatccaactgctggacagttttctccgcgggcagtactatcctcgaactgctcgtgtcataatccgaacaccatcatgtcctctgccaccccaccttacgaagtcactctcgaaaacgttgctcacgtcctccagcatgacacccgagtcaagctggccggtgtcgacgtcgatggcatgctccgcggcaagctcgtctccaagaagaagttcctctccatcgtagctgatggatttggcttctgctccgtcatctttggctgggacatgcatgatcgcacatacttcaaagaattgaccatcagtaacaaggagaacgggtaccgcgatctcgtggcagttccggatctgagcagtttccgtcgcattccatgggagaacaatgtgccattcttcctagtcagctttctggatcccgatacgagtgagccggtctgtgcttgtccgcggggattattaaagtccgccctggggaaggcggaggccgcggggtatcgtgccatggcggggggtatgtgtttccgccttatttcttgaggtccgctgacatcgtatcttccagcggaatatgagttctatcagttccgcgcaccaggaacacactccaaccctgagcgcaatgcgtcggccacggccacctttctcaaggagaaccctgtcgagtcccttcccccgctgacggaaggcatgttcgggtacagtctgacccgtcccatccacaaccaagactactattatggggtattcgacgcgtgcgagcagttcaattgtgaaatcgagggttggcatacggagagcggtcccggtgtatatgaggcggtaggttgcattgggtgacgttaaggtccctgctgacagtagcaggcactacagttcggagaggccaaagagatggccgacaaagctggtcttttcaagtgagtgacttcaagctacagaggatcaaactgaccgtgccagatacgtcgtcaagtcgattggcaccaaacacggcatcacaccaacctttatggccaagccacgcgagggattacccggtaatagcggacacatgcacatctcactggtctcgagcgatgggaagaatgcgttcatccgcgacacgcccgacccgaacccgccatatcccgatgtggcttatctctccgacctagggcgacatttccttgccggggtccttactggtcttcctgatattatgcccatgttcgcacccaccgtgaactcttacaagcgactggtggagaacttttgggcacccgttacggtatcctggggactggagcatcgggcggcctcaatccggcttatcaccccacctaccgcgagcgcaaaggcaacccggctggaggtgcgtgtacccggggctgatgcaaacccgcattttgttctagcagcagttgtcgcgttggggtggcggggtgtggagaagaagctggagattccggttccgcccctgtccaaaggcgaggacatgggcggggcaagcgataagggggtccgattagccaagtcgctgcgggaagccacgacggcgttcatgcgcaaagacagtgtcgcacgggaggtctttggcgatgcatttgtggagcattttgggggcacgcgggagcatgaagtgcgcttgtgggaggaggccgtcacggattggtgagtggatggaggtggctgcagtgatatgatgatactgactattagcagggaggtccgacggtatattgagacggtgtaacccggatggacggagctgcgtgtacaggccagcagctggcaagattagaagcccgtgttactttgttatttttgcttccctgttttgcccagactggtccagatcggacggtacagattggctgcagacgagtccgtggcaacccgagctggagctggggtcgggagagcagcggaagttagagttgacagcgatcacatgcgttcacatgtggaagagatgactggatgtacttttgatttctgtttcatagtaggtgtgtggcatgtgcgtagcgacatgaatgagcatacatagaatagctgtgacatttccatcatgttcgagttttttgcagccaggcctgagtcacaacagcaatgattgaatcagctccacagtatcaccaaaaagcactgtatcaccatcgggacaagtcggtcgagtgtaggcgatggccggaccgcaggaagctttgccaggacggacggaggagaggagcagacagggcagcaggatggcggcgaaccgcggttgggaggaaggctctcgggcctgcggggagtttaggagcttatcaacatcctcggttgactgcctgagtggctactgagttgcaagatgcagtctgcaagctgggcagctgcaacagagccagcaactaccgacccacgtcgggaatcatctcgagaccttcctggatagttaatatagtggccactactgacgaaagtactcgaattgatcgagtaagaagtactcggcctgaacgataagccgcgagtcggaatcggtagccggcgtgccccgcccgttatcggccgaattgcagctggtttcccgcggagaagtcacgtggactcatagctctggagcagccctcattttgggttcaatccagcttatcgggactccccatggaccgcggttactgagtgaatggtgggactgacgtagtcgctgtgtagacatatattccctctattccctccacctcttgtagctcagagtcgtgcttgttgttctggaaagctttctccgctacttccttctcttcatcatctcatctactgtacttctatcctgccggtccggatagtatctataccccctccccacatatacttcccgataagataaagcataccactccatcatggtgcaagtcgacacccaactcaaagacgtcgtcatcctcggcaatgtgagctcggaggctcgcaagatcctcaccaaggacgcatgtgccttcctcgccatcctccaccgcaccttcaaccctactcgcaaggccctcctccagcgccgcatcgaccgccaggccgagattgacaagggtcaccttcccgacttcctgcccgagacaaagcacattcgtgagaacgatgcctggaagggtgctcccccggctccgggactcgtcgaccgccgtgtggaaatcacgggtcccacagatcgcaagatggtcgtcaacgcgttgaactccgatgtctggacatacatggctgatttcgagggtaagtccctttctattaccccagattctccccgaaaagaatagcatctaacaacagacagattccagcgcccccacctgggaaaacatgatcaacggccaagtcaacctctacgacgccatccgccgccaggtcgacttcacccaaggcggcaaggaatacaagctgcggacggaccgcgtgctccccaccctcattgctcgcgctcgtggctggcacctcgacgagaagcacttcactgtcgacggcacccccatctccggcagtctgtttgacttcggtctgtacttctaccacaatgccaaggagctcgttgcgcgcggcttcggcccgtacttctacctccccaagatggagtcgcatctggaggcgcgtctatggaacgacgtcttcaacctggctcaggattacattggtatgccgcgcggaacgatccgtggtacggtgctgatcgagaccatctcggcggcgtttgagatggatgagatcatctacgagttgcgcgaacacagctccggattgaactgtggacgctgggattacatcttctccttcatcaagaagttccgcaagcaccccaactttgtgttgccggaccgctcggacgttactatgacggtgccgttcatggatgcgtatgtgaagttgttgattaagacgtgtcaccgcagaggagtccatgctatggtaggccaaccattccccattatacttgatgacgatgctaataaacttgtagggaggcatggccgctcaaattcccatcaagaacgaccccgccgccaacgacaaggccatggagagcgtgcgcgccgacaagctgcgtgaagtgcgcgccggacacgacggcacctgggttgcgcaccctgcgctggcctccatcgcctcggagatcttcaacacctacatgcccactcccaaccagctgttcgtccgccgcgaggacgttcacatcaccgccaacgatctcctgaacaccaacgtccccggcaagatcaccgaggacggcatccgcaagaacctgaacatcggcctgtcctacatggagggatggctccgcggtgtgggctgcattccgatcaacttcctgatggtacgctccatctctatcccaaatatcccaagaataacatatactaataaagaaataggaggacgccgccaccgccgaagtctcccgcagtcagctctggcaatggacgcatcacggcatcaccacctcggacggcaagaaggtcgacaaggcgtacgccctgcgtctcttgcaagagcaggcggacagtctcgcggccaagggtccccagggtaacaagttccagcttgcagcgcggtattttgccggccaggtgacgggcgaggactatgccgatttcctgacgagtttgttgtataacgagatttcgtcggcgggcaaggcggagccggctgctaagctgtaagctgagcagtttgcacttgattttcttccgtaatggtgttacgatatgtttatggcatgggtcttacttgtttatattattaggatggatgggtttgtgggtttgataggctggacttattattatcatcatcattgttgctgcgattgttattgtggcattacacatattgaatggatgaatgcattttcattagagatgatcctcggtatatccaagttgataacgaagttactgctgtattggcacgttgtatatcactctgagatgcgtcgtacagttgttgccagtcttgaatggcatgagggtatgattaagatgtactcggtaggatgagtactgttagatactatggttcttttaccagtagtatattctataatcaagagtattttacgctataagtctcaaccgtactcatcaaggtatttatgctgcgattgaattgtctgattgcaattgtattcatcgaaaagtagttgattaatcgactaattaatagtacctcagtttctttgactgactgcctgtgcctcttcatctgcccccctctgtctttctcaacatagatcccacgaaccacctgatttttgcacaatacctcaccacaaacaaaagtataagccaatccactcatctcataaaccatacttcggagtatataaccaccaactcaatgatcacaagaacataccactcaccccttccaaacattctacgccttcctttactatcattccttttctacttctaaatcatacatcaatatacattgtgaagaaacagtaatacctacgtacaaacctcaaacgatgcaacacagcgatgctccggtagcaactcagtaaccctcactgcaacggccagctacgccattccataggccaggtcttttcttctcgatccgacggccaaatagactcgaagatctccaaatccatactccgcatcgtctggccccgtttgcgtttcggcttgaaccggttttccacccgcatcccgttggccccatcccactcgacctgccacgcgccacccatctcctggtggtaactcccatctccgagcagcgcatgggccgtgatgcccgtggatccctgatactgcccagcctggcccgagagggggtgcagtcggagcactcggagggatctccccgttttctggccccagatgcgcgtgaagatcgctgtagctagcgtttcgtcgaacgcactgttgatagcggtgtcccgaaccgtccacttgggaaggctgccatgccaggtttggatcgtctggcgctcgtacgcagtgagctcccgtggggggaacggggtctcatagcccgagaccatcacgggcaggcagttgaggtgaaggtccagtgtgtggagggctggaaaacggcctagggcgtcgtaagcggccgtctcggttgagtggccccggtatcgttgcacggtgatccgcagcgtctgtaggacaggacagcgagccgccatgttggtgatcacgtccgcagggaagatcggagcaatttgccccttccgcgcgagtcggtaggactcatagttctggaaccagggtcggggcctgtgcagctgcagctcggttagcgttgggccgtggcggtccaggatagcggtggggagccattccgggtggtaggaccccagcaggcagagataggtcaggggcgggagggcgttgaacatggttttgactgccgggagccaggggggagaggtttccggggagttcagggcgagggttagtcgctttagggcccggaagggctgcagttcggcgatggttgttaatagggcgatgtcctcgatggcgccggcggtccacgcggtgagatatcccagatcggtaacccgggaccaggcctgcaggttctgcgcggtcatcttgcttatcaatgggaatgaaagcatttccagttgcgcgcgtggatgggtattgacctcgtcctccgacggctgggcctgcagccacttggtgtaccgctgacaggagctgggccccggcgtggcgctgatctgcaacgtcagacgcttgatccccggcgcttgacggagaatgttccgcagaaagcgatccgggtgctcggtgtagaagcggccattgggatgttcatagtagacgatccaagcggccttcaccacgggagagtggatccatttatttcgcgtgaaatccgctcggtaggtatcggggctggcggagaacaccgaaacgtgacagtctggatgagtctccgctagggtatccagcagtgccggcgggtatgatgggtacagtaaaagatgaagccgcttcagacacaccaaccgttggaggaggaagataatcgggtcccaatcccctttgtatgcgcgcagtatgggagggacatcgatattctcggggcgcgtctcattgagatacctccctacgttgagatcacctaggtccgaggtggtgggatctacgagggtgagatatctgatatgcggcaagacgagagtggcgtctagcagctgaagcacacggtgaggtggctcgttcggcttcaggcggagagtaagatctttatagagacccggcgccgtaatctggttccactggcggttcacctgtgataaagcccgcagggtttcccacgacacatcgcgaatctaggttccggattagttggtttcaaaggctaaccgcagtgttcttactattccagcgattaaatgctttacctccaggggtagacaatccatgttcacgagcccgtaagatggcagtggaaaagatgaaatgagatagtgacggggtactattatacattgaggactgttgtcaggtgactatactcatccctatggtatataaatgcttcacactaattttctttccatctcaattgcgtgataaattatacctcatactaacgaagattattcctttcaataaaccatcctgtagatgaataaacaagataaatgcatgcactatcatcaccaacaaggaaccaaacccacagcaccgttttcacccatttccaacccaacccttatacaaactatcctccccccttcaaaccccaactaccccccatccccatacccatcccgactccctcatccaaaaccctcccaaacgaaagacaattagatatactcccaagcccccacactggcgttcctcccccacgccctcgccccaaaacccaaacactcattaacattccccccaggcaccgtcgcattcttccaattaacatacacaatccatttacccccaccagctcccggcgtggccgacggactcaccgacggactcaccgacggactcacataggatgaagaaggggtcgccttactaggcttcggcgtagaactaggctttggcgtactcgatgacccaccatggacactactactactagcccctcccccacctcccctcacgggacaagcaatgaacccacccggagagcccgtataattccagcttccgtagggagtacccggcgtgtagctgaatggaccggtggatgagccgggaggcatgtaggatgagtgcggggctgtgaatgataaggcccccgtggggaggatgtagatttgttggccgccggggacggagactgccttttcagggttccccggaggggggttgggttagtgggtggttgttgagggtggggatatgggggataaggggtaggggtaagggacgtactaggccattcccaccaacgataatggtttcgtttcctggggggcattcgccctccgaggctacacctggaggacagtaggaggaggtgcggccgccgaggtagaagcggccggagaagatggttaatgggaggttgttaatgggggagtcggagcggtaggcggtcacggtgaaggaggaggtggatccggaggagccgtcagaggatgaggaggaggattcttgggtgtaggagggcgtggggaggagggagagggtggtgaggaggagggctaggatgttcataattattctgtcgtatggatgtcaaagggtggtggaatggagtggagtgtggtgtggtgtgtaaacaaggaattgtagtatgagttgagatagggctttctttatactaaaatctactgtaattcagtgttgatgtgatctctctgaagtcatccggggaagtattccactgaattggtgttgcagttggaacgggtagggtttgggcggaaggcattcccgcagcgggggaagtagacggtacggcggagatgggcatgatttcatggttatgctgggcttcagatggattcaatgggttcgtgtaggtgctgttgggacagtgagacccaagctaagttagtttagctgaccaaatcccatgtgattttggttgatatggcgatatacctgtccttatcaagggttgaaactggtcttttactttgtctatcactcctcaacccacttgaaaacatgctagaattaatgctcactactgacagtctggtctcaatgcaagttcacaacaagcacaacaacaagatcttatcacccaatcttcccaactcatcctagaagttctatcgagtcagccatatacatctaatacagcctgtgagaaagacagtccgcactcactctaacgtttcttgggagtcttacacccacaatgttcagttcgatggacaatcaccatgcatatggcctactccaccacctataaaatcacctcagttagccccatccacacttcctcccatcagcgaactcacaagaaaagcagacaacatttcccccacagtcagacactttatggtcgctaccattgcctaaaatatcagccagcgtcagcccactccgacatatctgccactccaaattatacgaacatttaccacagcatttgtcacaatcagcctcccagtgctctggggatccgcagttgcgacacctgccttccacatgtcggcgagaaatagcctttctcatgtctctgtgagcccgcgagagggcttcccaagacaaggagcgggacacccttgccctcgggaatccgtacgcgctgccagatctatatcccctctgtcgggtaacctgggatgaagatcgggaatggggctggtgcacttggatcctcatcctctgtatataactggtggggttgttcacgtccacgccgccgccgacctcacgtcttctagatattcacacattcatttagccccatatcatctcagcgtatgcttcaacatcaataaaaacggaagtgagaacagtcgtgtatgcagagaatttcgaacccacctaaccctcgaaacgaattcaacccggaggactgctgaagcgttgccctccatgattgggctgtatctgtaccgatagatacaataccgaaggttttagctaaacgcaaaggaaagaaaaaaggcaaccgtgccaactagataaatgagtgaaatggagactgacagaaagataggatagaatgtgaagagagaaagaaccactgcaaagacgataaatctgggggtatttgtattctctacagcaatcactgacccactttcctgaacacagtctcccacctcgaacaccacctccacccttgacgcgacttggggccaacaattccatgcatctgcaagagggggagagaaatgaacgaatcagaccaggacacactgttggaatcgtgcggtagtgcggtaacgcgcgtgtgcaaggctgcgggcagaggttgcggtgcaccgcctcagccatccatcaatgaggctttggtcgagtacctactactgcctagtaagacttgttcgcttgtgatgtcagttctgctgtgtttgcgtagcagcaccgtgaaatttcgaaacggttatggtccttccgggtcgtcgggctgagagctgtcgtatcgtataaggtcgaaagcgttggatgttagatggtaatagggacagtggtatcatcatggatagggtgtaatggaagggtcgacatatgcgcttgctggtccgggtaggctcactttgtccttactatgttcttcatgcagccccgcttacaggcgatggctcagcacggacgagagaaaaagaggtaggagtaggggccatactgcaacgagaacctgcgatgtacttccaaaacatcattgatagcaattctatatgtacatgaaaatctaataatacctcaaaatctagtagtatccccgcaacgggaaatctcttgaactctgccctacccaaatctcaaaatctccatccggcatcacccagttttgctgccgcacactccaatagctcaggtccttccggctgagactcatcgatactgtctgcgcctcaccgggctccagggccaccttggtgaagtttcgcagcacacgcaccggaaagtcgattttctccggcacccgttcgatcttcgtcttgctactgctccgctcatgcacctccacccagtcgccctcctccgtcacttcctccgggaaggagacatacatctgcaccaccgtctgacccgaccggggtcccgtgttccggacttgcacttccacgttcgccatctcctcgaacagagatgggttgccgcccaagccacctccggcttctgacggtgtccgcggcttgtcatagccgatcgggtagtgcgtgtagttcgcgggagtagtaccatccagagatggcagataggggtagatatacttgctaacaacgttgaaccccggggggaagaagaaagactcgttccgtggcggctcaggatcatacgctgggggagaaatcgtggcgggacgcctcgatgcgggcagccgcgacttcgaccgcaaggcgtggacctgcaattcggccaactcgaacgtagcgtaagacagcccataaccaaactcgaaccgcggagtgatattgtggcgatcgaaatagcggtggtcaatgtacagtccatccgtaaagtctacctggggaaccggtgcattaggctcgtacaacacttgcgcgcccggcccgtagtgggccaggctcttgcccaccgtgtacggcagccgaccgctagcatcgacctctccaaatagcacatccaccagagcgttgccactctcctgtccgggcagatgcgcgaacaagacggcggcgacgcccgggaggtcaatccacgactcgacgaccaccgggcccacggcgtgcaccaccaccaccgtcggcccgccacagctgttggctaccgtcttgatcagcgagtcgccgcccttctgcaggaagagattgttgcgatcgccgctaatgccgcccgaagagatgtaaccctcgccggagtcggcgttcgcaaacaccaaacacagatcccggtcggcagcatcggcgggcatcactgcatttcgcatgtatgaatgcatgtcgatctcggtagcccaggcagtgttcaaagcatcgatcggactaatcaggtagggaaattctaccgtcccactaccccagcccatggccagagtgccctggttgcagcctcggtctgggcaagcgttaggtcctccggccggcccggcgtcgtcgccatatacgcccacccgatagggaccaccggatggactcactggccggcgggacaagggcagtgtgttctggtcgttcttcaccagcacaatgccttcggccgccaccttgcgagcaatgatggagtgtgcgttctcgccttcgccctgagcgttgataaaccggttcacgacgccgtaggcttcatcatccggcgatccttggtgcagccatccgacttcatcgttggtccacgaggagaaggtgggcccgccgtcaccctccggaggaggccgaggccacaagtcctggccgagatggtaccaggaagccacaatgcgggtcaccatgtcgttcaaccggtccatcgggacagacgtgttcaacactgctcgagtcagctccggtccccacaaggaccttccgtctgcccagtggagaccatcacccggcatactcatatccaggccgcccagagcactgttgatgcctgaccgctgagccagccagtccgactgcacgaaaccctggaagcccatctcgtccttcagaataccgttcagcagcttgctattctcacaagcatggctgttgttcaccatctggtacgcacacatgacgctggcgacatcagcccggatactctcagcaaacggccaggcgaacacctcgtgcaaagcgcggtcgccaatgttggatgacatggccgaggcgattccccactcatgcggctgtcggaagtgctcttgctcattcagaatgtaatgcttggccgtggccatgacgccattgctctggatgccgcgaatggtctccgcagcggcgacaccctgcagcacagggtccgagccaaacgactcccaattgcgaccgcccgcaggcatcataccgagggagcccattgacgggcccagcagcacgttgacaccctttatcctggcctcctctcccagagccacaccgcgctgtcggatcaggtctcggttccaggtcgctcctgttgtaatgccggcggggaaggcggagatgaggtcggcgtaacgcagtccgaggggtccgtcctgtagacacagcgaggggaacttgaccagatcggcggagcctgagcagttagcagccatcacccctagccttcaaccagacatacctgtattcccgacacaaagccccatctgccatccaacgccagtagtgatgttgatcttctcgatgagggtcatctgtctgaccagcgcctctgccttcctgtaatcctccgcccattcctcaagcgcgcctcccttgggggtagggaaccaagattccgccggggtcatatcctacagacatcagcatcacactcactaactcaggtataaccacaaacgaacccgttcagattcatcttccgaccaagccagattcaaaaacgcccaaaccatcatacccaatgcgacgaaaataacgaccagcgtccgccacagccatcgagaataatagtatgcccgccatccggtgcggggagtatgtctccggaacgacgaggttctccggtgatgtcccttctttttcttcttcacggtgtagtctccatcatcgctgtcatcggtgagctcgtactgcctcgccgccgccaggagctcttgttccgcctcggtgatgctatccaggtatgcttcgacatcggtggagcggcagttagcgtaggcggcggcctcgttggacctcttggcgttgtcaactcggcggagctttatgcgggactcatcatcgaggtctggatcagagaggtcggagagagtgaaggtttcagagtagcgccggtcatcgtggacctcttcggggatggattcatgtaggggggtgtagcgttgttgctgggaggatttcctgccggaggaagagttgtcccgaaagggaagcggcatggtgccttacagggataggagcattgagaaagagattcgaggttcaagaggaagcaaggggagaaagagaaaaagaagggaccaaaccagggaggagaaaggggagattaggatggcgagaaagtggatggggatggccagacgtggagaaagctgggcgcaaagagtaatgatacgagccatcatttcaaggcacccgccccgctgccggccaatcacgatcacgtccatctcatggcttacgacgttgcgggccgatcatgatctggacccgtacctttttgctgggaccctgactctgactctatacggagatggatgttgacatcgatacatacattgggatgggcacacagttatataggattgtcactcttaagtgagactcgcctccgccgcctccatgtgtcgcgccgtctgtccccggaaggaccggcgtccccgcaacacccaatcgagggcaatcagcacagcaaccaccccatataccgcggacacatagttcatatctagtcactgaattagtagtcacgttaaaaagaaaggataaatgggtattgttctgggggccacttactgcccgtggtaaccggatataccgacggaaaggaatatataaccaagcagaacaaggtccatgctagaacaataatattacatactaggccgagtctcccaagccagaaaggaccgtgcttgagagtaccccgaccgcgccacagcaagcagacaatcggcaccacgtacgaagcgtagagtaacacaatgcacgcagtgaccatgctgttgaaggcagtcgacgaaccaaggtacagcagccccagaagacccactataaagcagctcacgctgtgcgcgttaagtgggacatccagcgtgggatgaacctgggacagaaacgccgaccagggtaggccccggtctcgtgcaaaggaccagcataggcgagattgccaggtatgacaggcaatttggcatccgatacctgtgacaaaaagcaacgtctcaagcacaatggcgccagctttgttctgcaaggcttggtaatacagtgcgaggatgggcactccggtcgggctattgaggatctcatcgaggttgttcaggctgaaaaacatggagatgcagtaagtccatgaggtgacaaagccaatcaatacggtacagaggatcgcaatgggaatgctacgctcaggttgcccaacttcctcagccaaatgggtggccgagtcaagacatgcgaatatccagttgggattgatcagacccacgaggaacgcaatcccgtcagagggccagcccgttgagttgacaaagtgagcaaagacgaattcagccgaactgtgtgtgggagctgccgcaggaacggtgatcaggatgacaacgaacgagatgagggatatgtatagggttgtggtggccacggtaggaaggactttgccgacgcaattgaacagataggcgaaaaagttgaccagctggtaggctaccactgaatgccatggttgaggtgtactatatcgttagagaagtcgcaatccaatctttaacaagaacatacaagtccggatgtgttagctgccacatgccaacaccagcagaggccaggcttaacgcaacactggcgcaggtaaaaatggcgcccgcccaagccaaccagcctgtcagatatgatgcgaacgacgcatatttcctcggcgccagctcactggcccaaaagtattggccacctgcgttcggcatggccgatgccaattcggacaggctgactccaacgcaggtcgaaacaaaagcgatccaggggatgccgtagatagtcaacacggtgcctcctgagttaatgcctgtgatcaaggacgcggagataccgaaccatgagtttgccagggagaaggcgaccccgaggagcgacagcacggagaagttccgctgcatgtcctgggtatagcccatctccgccagtctcctcgcatcatcgtcgaggtgtgcagaatggtcgctggccggactagctgcggacacgttggtcttgggtcgttccatagtttcgcgagagtgttttgattccggggtagaaagtcatttctgtgtgcgggggaggctatggaaatagtcgcgtgggctgcgaggggaacaaaagcagcgtagtatgcaggcgttgcacctgcattggccacccgccgatctcgtcggatgatcgagaaacacagccagttgcatgagggggataacaatctgtcggtcagccccggagaccccgatggagccaaggatgtgaggccgtactgagcactgagggggcgccgttccccgctttcattggcaaggttgtccccgacttcaggatgagatcaccaagtgcagaaacaaagcagtggctgaggaagagcagattaagttagtacattgaaagtagaagcggggatgcacaggcacgtggacacacgtggtaacacagcagcgagctatttgtttactatcgatccaaggcaaaataaatagattccttgagagtcatgtgcaaaaagttcattcagagcaagtctacatctatatactcgtcaagcctcattaatcaagcaataaaccagccgtctataaggaaccaaagccagaacatgtctaatcacaccgctgccgatgcaaacgaaatcatcaaactcaaccatacatgtttactcctcgtcatcagtatccgggggcttgggtgtgcccttgggcgattggagcctgcgagagtcagtaaggggagtacttgagacaagatagtgggacgtaccattcaagatgacggagacggcggcgggcctcacgctccttcagctgagcacgagtgagcttcttcttcttcttagccttgaacttcagctcgcccggctcctccgctcccgagttgacggccgaggcggccgcactcgtggcagtcgagttgactgccgtgctgccgggctgaggagagctggcagcgctgtcctcaaaccggtcgagcgagatagcagtgttggtgcgagagacgatgcgaccgtcggcgacgtgcagctgctcggggcagagagcacccacgaactcttcgttgtgagagatcatgacaacaccacccttgaagtcacggatggccacagccaatccacccagggagtcacggtccaagaagttagtcggctcgtccaggacgagcaagtgagggttgttccacatagcacccgccaacacgaccttgaccttctgaccaccggacagaccggagatctcgttgtggttggcaatctcgggatccagaccgatgtcctcgaagtgcttcgagatgaccttggggtcgagcacacggaaaccaagaccctcgcgcgacgcctcgtggtcgtcaaactcttggaccagcttgaagaagccgaggttgagcagagtctcacgggagatcatcgtgttgtgcttgggcagaaggccaacccatttactgcacgagttagcaatgaacagggtggaaagatccgttgagtacttacacttcatactggaaggacttcttccacttctggcgacccatgagcgcctcgatacggcgaggtccacggccatcacccaggtcaaccggcttctgcagctgagccttgtcctcctcggtgaggatacgggtctgcttcaggtagacctcgcgatcgtcaccgttggcgtaacgccactgcaggtactggctgggggtcttctccaagtgcatctcgacgtgttccagggcgtgctgcttgatgtaaccgatacgcaggttggggtgcttctcgaccttaccggtctgagggatggtttcacccgtgagcatcttaatgaaggtcgatttaccggcaccgttgccaccaatgatagcgacacgggacgacaaagtcagagacagggacgcgtcagtgagagacggcttgctggcgccggggtaggtgtaggtgcagttggtcatgcgcaggatggcacgggtgttggacttgataccagccaggataccggggggagggaatttgaattgaacgatgctcgccgacagggtgtagtagctcttggcttcgggcttgaccttgacgaaatcagccaagttacccttgtagcagacaagcttcttctgttcgtagtggtagatgtccgtgcagacttcatccaggaagcccgagtcgtgagagacgatcaaactggtgatgtcggtgtgcttcttcaggtactcctggagccacttgacgttggccacatccaagtggttagtcggttcgtccagcaggaggacgtccgccttgcgcagcatggcacgcgccagagcgagcttcatcttccatcctccggacagggagcccacacgctggttctgacgaccctcgggaccgtccgtgaagccaaactcgagcaacacgctacggatgtgctcctcgccttcagcagcaatcatgggatccttggagacgtactcgaagatgctcagatcggcatcttcgccctggttatgctcgacaaagcaggtacgaacctcgctctgtggggggaagccctccagcttctcgttggcgatactgcgcatgagcgtcgatttaccagcaccgttgcgaccgcacagaccgtagcggtggcccttgagcagacgaaggttggtgtgggacagcagaagcataccaccgtaggccagagagaagttggcgttaacaatctcgacctcattggggtcctcgggggcgggcttgccgaacttgcggtggtcctcttcgatgaagtgctcctggacggcggtggcgaccgcgtcgtgcttgtcctcgtgcagcagaccgcgcaggtacggggcaatgcaagcgggaatacggtcgtgcatgcggcagttgacatcctcgcgaaccatctcggcgacgtagttcttacccagggcatacaaggtggcgtcctcggggcgtgccaggccgccgtgctcctggatcttagcctccaacacggccaggacttcctcgggtgtgatcttcacaaccacaccagcggccacatccttgtcggccatggctttctcgatgacgtccaaggcacgagtggcgagctcacgaacttcgggcagggaggcacggtccttgacgcgctggacaccgggcttcagcttaggcaggaaagtacgagcctcagcggggtcgtggacgagcttggtcaggttctccacgacgacgacagtctgacgcagagtctcctggggagtcgtgggggcgttgagagaacgttcgagcaggggcgtcagcagagcgagaacgggggaggtgacgatggcgacgaaggtagtctgggacagggcgtggatggccttctgcagagtctgctcggatggctgctccatggtcttgatcagaaggggaatgcggggagccacatcgtcgttggacagaagagtggtgagagcgttcatcgccttgatagccttcttagcgacctcgttcttcaggtcgtgcatgccggactcgaccaaggggatcagatccttcagggtcttgcccatggcctcacgcaggaggtccttctcgcgctcctcctccaggggtccagtacccatttgcgccttggtagccatcttctcgatgaggctgtaggcaccgacgaaaccctgccacttggctgtactctggttgagataggcggagacggcggggaggagggcgttgaccatcgcctcgggcttgaggcacgcaaacagcgcatcgatagcatactgagcagcatcgcgcacgacagcacccttgtcggccagcagatcgagggccaggttcaggacaccaccgtcctgcagaaggaagacgacttcgctgagagggtgttcgcgggggaatcgctcgaagagggcgcccaggatgagcatggcgctttcgcggagggcgccattcttcttgtcggtggcagccttcttgatcgggggcaggatgttgtatgtacggaaaccggagcagccgacactctggatcaacaggttggtgagggcgtaggaggcatcgagggcctgctgagaggtctcggcctggaaaatggtgttcaggatggagccgacctcatccgcggagggaggaacaccggagggggttttggagacgacggtagtcatggctggggtaggatcttcaggatgaggcatgatatcgtaagatctgtgggtttgggggttctgggcctctcacaccggccggggcggcgggcaggctgagaaaaaaaaaaaaaaagaagcgaaaaagaaaaggacaaaaagaaaagaaacgagaccaaaacttttagtgggcaatcctcggcaaggatgcgtataaacagagaaacagaacggggtatacaacaaggagaaggagaaacaaagaggggagatttggaggagaggagaggagaggagaggcgagggaagttgaaaggcgagcgcaagaggaaaaacaagatggaggcggggccgataacgagcctgaggatttttaggcggcggcccattggatcgggcggcgatgaaatctctgcctcaggcgaggggctgatagcctatcatccaggcacgcgtggctgggttgtggcggtgccaatcccttgctagcctgatgtatcaggtgtcatttataccatcattgcctaatatatcaggtgtcagtttagtcagtttctgcctgaaacgcggtaatataatgcctgaggctgccataacgccgccgttgcccgattgggcttaccccgcacgggggctccacctcgccggaccaaaaatggagtcaagcatccactgccaaatgggaggatcagcttccctttcttccctctgctgttccgaacatccatcgtccatggacttgtgaagggaatgcatggtaccaaagcacttctctgctcttgcggttggatcttcctcatccccgatgtcgcctcaccgcattgtacgatcgatcgacccctcacaggagtcccccgaggcccggcgtgacgggatctgcagccaaatggatctaattacaccatgatgataactaaaagtgcagcgcgcgctctactgcacactaccgatttagtccgacggccggctcggcctcgcatcggcggtgaggatgtgcacgacagagggtggattggacgctgactgcttatggctgattgtgttgaccgtccgcatgcagccgtgccttgcctcggctcctcaacaccgcggccaaccgaacggccactcgctctccttccgggtgaatttctcctgactctgctttgtactctgctccgtgtacataattcctactctctctcgtctttgtttgcacattcagccttcccgaacactcatcatgtctttctccatgccgatacgtccaacaacccgtcatgccagccggctggctcaggtacatacccctcccccttgatggcttgcctatcattgctgacaaccccaggccaagatccgctccggccggctttacagcaccgaatcagacctcaaaaccgccctgaaatccgtcattcccgagaagcgggagctcttcaagcaagtcaaagctcgcagcgacgatgtggtcggcgaagtcaaagtgggcaacatcatcggcggcatgcgcggcctgaagtccatgctctgggagggatccgtactggaccccgaagagggtatccgtttccacggcaagaccatcaaagattgccagcgtgaactccccaagggcaccacgggaactgaaatgctccccgaggccatgttctggctgctcttgacgggccaggttcccaccactagccaggtgcgcgcattctctcgcgagctcgctgagaagtcgcatctccccgaccacatcctcggcctgatcaagttattccccaaggacatgcaccccatgacgcagctgtcggtggcggttgcagcgctgaacaccgagtcgacattcgccaaagcgtacgagcgcggcctgaacaaggcagactactgggagcccacgttcgatgatagcatttcgctgctggccaagatcccgcgtgtggctgcattggtgttcaggtcgaacgagatcgatcaggtcgggacgcaggcgctcgacgcgacacaggactggtcgcacaactttgccgaactgctgggcaagggcggggccgagcacgcggacttccacgacctgctgcgactgtatctggcgctgcatggcgaccacgagggtggcaacgtctcagcgcacgcgacacatctggtgggcagtgccctcagcgacccgttcctcagctacagcgcaggactgctgggtctggccggcccgctgcacggactggcggcacaggaagtgctgcggtggattctggcgatgcaggagaagattggcacgcaggtgacagacgactcggtgcgcacgtacctgtgggacacattgaagtcgggacgggtggtgccgggctacggacacggcgtgctgcgcaagccggacccgcgattcgaggcattgatggacttcgcagctacacggccagatgtgcaggcgaaccctgtgttccaactggtgaagaagaactcggagattgcgccagaggtgctgacgcagcatggaaaggtatgttcctggtcaccacctgtttagtatcagactaacatatcatagacgaagaacccccaccccaacgtggacgccgcctctggcgtgctgttctatcactatggcttccagcagccactgtactacacagtaaccttcggcgtgagtcgggcgctgggacctctggtgcaattgatctgggaccgggccttgggattgccgattgagcgaccgaagagtatcaatctgaagggattgatcggcaactgagttgatataattgactgttctgtatctagccccgagtaagcaagcatcatgtagaagtcatatctcgttatacccatattactccaattaaataccaacaacagagaggatcgtatcactccctctcaaccctaacctccataatcttctgaatcctccacccactcccattcccattcgcattcccactcgccccagcactccccgtaaccatactactcgaactcccacccccaaccgcactcaccccaaacccacctcctccatacccggcctccaacatatcctcatcaacaccaagaccatccccagcaaacctcccctccctgaccctcgccaccgccggcaaactacaaatcgtcgtcgtcgtcggcgccaccccactcccatcccacacccctccataccccccaccaccaggactacaactcctctcctccctcctactaccccgactccgactcctactcctactcctcaccgaccggccctcctcactcgcactcgtcccaaacaacatcccactctccaatcccaacccatccatccccaagccccgtgcaacctcatctaaactcgcatccactagatcgcgactcttcttcctccccccactagtaactatcgagctcgcagtggtattcctcgtctgcgtcttccgcaacggatacgacgtactcgtcgtcgtcgtgggcgaggtcaaatacgtaagcgtagcgtaggtattatgcggattgttatatgtattgtttgtcgtgtatgtgcggttgttgttgtagctgctggataaggtggatgcgaaggcgtggaagaatgggccgtacgtcgggatgcaggttattattacctataccattagtgttattagtatgatgggggaagagggaagatgggatgacatgggattgggggaagcatacgcctagactgatttccacgtcagaccagatgacgatgggttggctgtctgtgtaggtttttaggttcttgattgtgaagattcggatgatctggattattgttatgaagaagccgagggcgaagacgccgacgagagctatctgttttttttttataggtgttagtttgtgtgttggggggtggtggaggggtagattggggagaggtggaggaataccttttggcgtagacgcaattggagggttagcaggacgggaagggggagggcgattatgattatgtcgaagccgagactggttcctgttttctttagtcaatatgtctggtgagagtggtggtggtggtggtggtggtgtacctgcgagagctggttcatcgttagtatatcgttgtaaaataggtataaggggttgggctaccataataagacgctaccgtgtctatacatgatccagggagacttgtatcccattgccgagcaacctacacacattagcatatacccacacataataaaggagaagacgtaccggattacaagcgaaacacaacaagaaagtaaacaccaactgattgcacgtcaccgccacaatagccacgatgatcgtcacgcggtacgcctgcacgaagcccccgatgcgcaggtacgatgacagcagggagactttgaagccgagtaatgcaagtgtgtagacggggccaccggcgtattggatctacatcatattagacatttatccaacttgatgtatatttgatggggatgtaccttgctaaacatgaccacattctgatcagggaaataccttgcatctagacctagaccccatcttgtttctaccaaccacatcagcatcatacctttcatattatcattaatgaaagaagaaggtatggaatctcacgcgcaacagcaatcccagcatacgtcatggccagcagggcactccatagcgccgcaaaatcatccagccacgccgacctcttcgtatgaatgcgaatatacagtctcaagaacaccgccaaacaagccgtgatggaaaacacaagacagatagcaatgacgcgggagacatgactgtggggatcagggacggtcagattatagacccagcccatttcggcatgttgaagtcaatcaatcaatcaatcatccacccaaagatttcagctcagaatcgggcggagctgagcgatggggtttgttaatatatgatgatacgaaaatgcagaagtacattctcgcggcccccctgcagaaagaaaaaaaaagaaaaagagggtaggtaggataggctaagaagaaaagtgtttaccgctatgtcaccctaccttcaatctcctgaaatatgcaaataaggaattaggaatttgatggatgatgtgtcgacccagacctgatctgaactcaatctacggtctacggccgcacccggaccagaacagaacaggaccggccgggagtggaggtctggttcgtgtgagaggctaatgagagtttagtactatttttcatttctttcatttctttttttctttctgcataatgctagagcctgacgctggctcgtgatgagattcgcatgtgcctgcatggaggtgcacgaggaggggggaataatgataggtgggaaagtcagctctcggtcaatgcgcggtccactttatgcagactaattagggcacggatcactctcaccatcaactagacaactaaagaacaaaagcaaagtgaacagaagagaaaaagtaaggacaagggtattcatccatatcccatctcaccgaataatcccaccacaacatccaaaacactaatcaactacgtagcaaaacaaggtttaaaaccttcaagagctatcatccacggtaccggatctctggtgatttcatatcccgatcgcatcggggataaaggcacgaatcaaactcgccggaaaagaattcagtgtgagcttttgagtaactattgagaagatgttcggggtttctctactgtgcgtggttaggaattagtcggtgtagcccgggggaggaactttcaagtagtagactagcaggggggaaaggcccttgtctagtggacattgattttagttagggagtgtcgatcatcatccaaccacggaggaaccacgggtgaggaggtgtctgctatctatttgcctttggcggttatgtgtgtgtgcgtgtatgtgtcggggacctgagcatgcatgcatgttcatgttcatgttcacgttctgttcatgtggatgtggatgtaaccgacttggtcttcgtcttcgtactttgtacacagcatcatcaccatcatcatcaacataaaagaagctgatctaggtttattaaggatgatccgatccagcaatatttattcttttttattccggccaagtattgaacatacctttcttttcttctgctaatccttctgcaccgagtgaggcgcacagtaactaaatccttgactaattcaaccagaaccaggatagcccagctataacccacactattatagcactattaattattcccgcagcatcaccaccattaatcctccccatccgtgcatgcacatcccaccacagcaggtccagcagagagtacggaccacattcatggcatgaaaagtaaaatacccgacagcccgaacccgatcaagtccgcaaacctggtagccaccatttaaatactattttattagaagtaattgaaataaaaataagattaggtccccgagcagtgggtatgtgtgcacgggcaagttacccagccactcatgacaaggtgtatagaaatctaactatgtacttatgaaattgcccaacaaattaaagaagtaaacaaataaaaaaaatcaaatgtatttacgaataaccttccgcatcagcagaagacgaaacccgacataacctcccatcaggatacatcgtccactcatccgaacccaccgccgtctggccataaaatacatccagcgggtcatatttcttcttgatctgtcgtagtcggggatagttcactccgtagaatgctttttggaagttgggttggcggaagtcgccctacaccatcattcattgttagtcaatcattatccttcataccccgaacaatcgattttgtagtagaaaggaaggagggatacctcattcatataagcccccgaatccggcgccaaccgttccaacaacggcaaatactcatatgtcattttatactgctgcactagcatgttctgccgggcatcccactgccacggcgtcgtgagcgtcgtatcaatcaacgtgtcccgccaagcaggcagcaccgcattatccacatccccgactaacgccttcgacacattcagtcccaccccgataaatgtggcaccgtcttccgtgatctggcgataggcggccgtcaaggcggtgttgttctcgcgcaccaccgatcgcgggatcagccatccgccgtattgcgcttctccgacggggatttcaggcatcatgccgttgaattcgctgaggtaggtggggaattgctccgcgtacagggtgtatctgatacccattttctctaggccctcgcggaagggtttgagtagcgagatgagctcctggacggggatattcggtccagtcagcggagcgatgtagaaggtcgtgttggtgaagtaccagatgctcatggcgccggcgtcgacgatggtcgggaggagggagtggtagaggcctacagccgagtagaacgtatcctgggagatgttggcgttggtgaaagtgaggtttagtcctgaggtaggcgtgctggtatgtagtttggaggtcatggaccagacaaccccgtaagtgccgccgccgccgccgctcaaggcccaatacaggtccttgtattcgttgtcgcgggtggcggtgatgaagcgtcccgtgccgtcaatgacctcccattccaggacctggtccgcggcgaggccgtagcgcgaggacagggccgagtggccgccgccttgggagtagccgcccgcgatgccgacggtcggacactcgccgctgacgacctggtagccgtgggcatcggccgcctcccaggcttcgaagccctggacaccggcgcccagacggatggccttgccggagtaatgggcgtcgtggtggtcgacgatgtcgatgtccttgagatgatgggtccagatgccgagggcaccggcaccggtggacttgccgttgtaatcgtggccggtgttgcggacaacgacgcggaggttatgggcggttgcaaaggccagagcgcgcgagatgtggctgggctggctgacgttcacggcatatacaatgtagttacccagggtgcagggcttggcgatggggtggaaaggatcgcacgagccgttggcgaaccagggggccatgatggaggaggacgattcatagcttgactcggttagtggaagtgtttgcttttgctaggacgaggctgcgagtcagcctgactagaaaaaagcttactggatttcgggctccgtccattgttcgcgaaggtagttgcacacccctggtttgtaggtgggattgtggcagggcttgccgagagggatagtctggattagtcggccgtcgatggattcattgaattgagtccattcggctggtgagggccagcattcctcccccgggaagcagcggcaggtggtgttggagggttgaatggtcacggctgcattccctacggccgacagcagggccacgaggctggttaggagaagtaggcccgagaacatgacggataggtgcagatggaggaagtccgggatgaggatgacaggaatgccagcggtttataaaaggagccgtgccctgtgctagagtggcagccatcgcgtggcaggaagaaccgaagaagaatgaccgacgcgctaatccaggggaaattaccgagcagcagcagtgagcatcagcagttgcggagaatgttccatggtggaagttgttttcagatgccatgcgagtggagcattggggtggaggcgacaatcagacaggcagagaagagacacacactaaagacttagcggatactccaagagggtctggtcaatctgtctgtctcaaggatgaagccatcagcatccaccaggcagaaaaggctttgggcttgactatcgcgtggtgtttcgtcagtccttgccactagagaattagtcgactagtagttagtttgcatactcaaatcaagccatcctgattcaggatccatccgacctgcagcttaagctcctccccagcgcatgcgtggttttctctcgtgtctgatcctctgtttgcccctctcctcgtgcatccgatcatcccgtgcaaatgttctagccggcctcgtgtcgcggtcgctagcggtcaggagaaaggaatagtcctgatgctgacagacaattgaactacctagtcggtgatagtctagatttgaagcgggcggtggtccagcggtgacttgacggatgggtcggcggacgttccctccggacaaatcaggacaggatgtgcggatcagcaagggatcatgctttgggcatcccgtggtgcgatcgctgtctactgctgtaccaagtagatactctgcttgtactgcttgctggtacattggatctttggaatcatctgttggttgacttagggttgctatctgaccagtcttccgcacgagtcagttctccgatcgcgactagttagtaatactaaaacatgaataagacctccccccaaaggtcctaatacatcagcatggtcatgaatcgtcatatatatatacgcttctgcctgttatttacaacttcgcctcacccgcggcgagacgttgccaatctttctcaccaaactctatgtaaccctccgcgcccggaggcaaccaaaacagccggtcgcggtggccctgcaccaccttcgatcccaacttgccgggctccacgccctcctggcgcagcggccccttgttctgcttatgattatgaatatgccatgactgttccacgacgcgcaagaacaccggcaccgcataccgcggcagctgtgcacgcgcgaaccgggccagttcctgcccgtcgaacccgctgcgcgcctcgggactgagcaataaggccgcacatcctgcacggccttcatgatgaggcactttcactccatacacattggcttcctggatgccaggatattggcccagcacttgggccacttctgctgtagacctgcaaagcaattagtcaacaccccaatgacaaataagcacaatgcaaggggtaagatgggaaggaaaacatacacattctcactcttccaccgaaacgtatcccccaagcgatccagaaaataccaccgtccatccctatccctcctcaacgcatctccagaccgataccacaaatcccccttgaccaaaacatccctcatgaacttcttcttcgtcgctgcctcattacgccaatagccctgaaacgccgtctcatccggcaccttgaccaagatctccccgccctcatcatactccgcccgcctggccagcccggtcttctcatcgcgcactgcatcccccgtctccgcatccaccacaaccggcacatacgtattcctcagactcgtccgcagtaacaacccatgatgtccgacagctcctgccgtgtacggcccgcggttgagattaaacagcccgaagattccctctgtgctgttgaaaaactccccgacctcggccaccccgaaccggtcccgaaaccgctcccacacgtccggccgcagtccattcccgtacatcatgcgcaccccgtggtcccgatcttgcggggatggtggcgcggccagtagataccggactacttcgccaacgtacacgaagaccgtggcttgtgaggcccgaatgtcgggccagaagttgcgcacactgaatcgcggcgcaatggcgatgctgcgtccgccgactatgttggtgatcatcgcgatcgccgaggtcccgtggtacagcggcatcgcgctgtaccacctatccccgccggggccggacacgttcgtcatgttgctgttacggacggcctgggtggaatacatccgggaggtggtgaaggcgcagcctttcggcaggcccgttgtgccggacgtgtagaggaggatggcgggaaaagcgccggggacgtgggtggccagttggccatcgtttggcacggaggtcggaaacgaaagcaaatggttactgaaggcgtcgtcaacagtgacgagctgcatgcccagctcattctcgatcgtcgatcgtcgctcctcgatgcgagccatacaatcgggctccggatcaactagcaacaacttggcgccgctgatggacaggcaatgcaccagcgcatcgccagtcaggttgtaattgatggctgcgggggcgcagccgatgctccagagccctaaccaggcgaagatgaattccgcccggttctgcaggtagaacgccactaggtcgcccttttgcactcccttcgaccggtagaagtggccgtaccgggctgccgtggctagggcttcccggtacgtgtaggactgctcgcgcgtccagatacagaccatgtcggggtactgcgatgctgtggctgcgaagatgggccacatgcttagctgcccttgtgcggtggctttctctgtgttgcggagggagcgccgtatggctagcatgctgcgcgcatcgttggtgaggtgaaatttggcatctaggtaggcggctagagcgatggctgcggccgctgttgatgttgctgcgcggggatggatgttagcgctgtgctacacgacctacatagtatacaagtccaaggggttggggggtgatcacctaacgccatggtcaggccggttaccaagtgtgtcgctgaaaatgcagtgaagggaggaactgaatgtcaaaatggaggtaatttagtttgtcagggcatgaggggagggagatggtagatagatttcattgccgaccacatcctcggtccaagctactatgtatgtctctccgcatccggacatcatgcagggaggcgccggggagcaaatcaccggtgtcccaagggctaatgcggcgggggtgcggtcagtttctcctccttctggttctcaacctcgggtcaattagctggccctcaaattgcttttttggggagggaaagagaggaatgtttggaacggagtgggtcgcggagcttcttcaggatccataattctaggaggttcaacgttgcggttcccacccgctctggcgatgacccagtgttttgccccaacggatcggttatttatctatgcaacacgtgtgctgcggttaccaggtttctagctatctagctgtctaccatggtattgtgcactattctgtggcttggtggggcgtagatcggagggaagagtgatgacagatcatccaggggctcccttttttgagtcggtgtgatgtatgcaagggagaatgccgcagtgtgatatatactcttctcggtgaagagtggtttgcccccgactaaagtttgtccggttgcgcatgcctgagctgctgatggtcttgacctcgagcaaacaaccaggctgcatctacgtaggttctagacaacatctcgaatttctctctccgggatcaatcgcgcatgcactcctctttcatccggatgatgctccttccacgtccaggcatcgtccttctcgcgtccgttcgacaccccgttcaacgcgttggccacgtatttgccaatggtcggaaggaacttgtagcagtggaatgaacctcctactgcgaaataaagattagacagtcggtcgtctggatggcgggtgatgagcggatgctggctgggcgaaattgcatcccagcatatgcgccagtagtcggggcggggatggtcctcgaggaactgtggcagacgcggtcgaatggcgtgcagatgatcttcttgcagtgcctcaggaacatgaacctggtctgctagtggcactgagatctcgtgtccggacgcagtgcggatggtgttcttgaacgaagcggcggtcgtgaatttgaggatcccctccgcagtgggaggaatgacctcgcctgagtcgtcagcatgtccacgccaggccaggatataacccaccttgtcccccgtagacaaacaccggcagttgcgaatagctggatttctcctccgacgagagttggaaatgcgagactgttactcccgccgctgatacctgttgctctactcggtctggttccggcaggtccaagtcatcctccaccgaggacatgagctgacttgtccatgcacctgtggccaacaagacctttcgagcatggtagatggtgccgtctgctgttttaacaccactgactccctgttcgtcacgaacaattctgcgtgcttccccaacctcatatcggactcccagcttgatcgcttcttgtgccatcagctgcaacgcctttcctgcgtccgcccagccggcggatgaattatagtagtatgagccgaacggggagcagtctgttttctcgagcagtccgccccatgcgtgacggaccttctcttcggtccattcctcgaagacgtcgccgcgaccataatcgcggaagttcttccttatcaatgcggggacatcgctatctttctcttccatagcaatccaccccgaagggtgatagacttgtgcatcttggaagaacggcagcgacttccacgcttcgatggcctcgaaacccagagcgacgtagagagggttggtataatctgcacgaatgatcttgttgatatcggtagatgccgcgggggtggatggtggggcggcgcgatccaacaggacgatctgtgacggtcgctcgagctgctgggcaagatggtaggctgtgctgacaccaaagatgccagcgcccacgataagaatatctgggaggtcccgggaggtatccatgggggaggtgggaggtggaagatgagtggtggtgatggcagatgaaggttgacaatgtgatggaccacgtgcggggaaagaaagaggagaaacaaggagggggagaaaggcaggataagcaagataataaaagcattcattccattcatcgctggcaaccagacgagaaagtgttatcaatccaaccagccagccatccaaccaactaagcgggattgcatccctccagccaaacccctcgatcacgcgccgagtgagtctcggagtcttccgctttttattgcgctgaagccatcatggcataagcatgagtccatccatcctgacaacccatcttccttctttccatctccgccttccttctcatcatcgtcattcttcaaccccttggtaccctcttaccggattccatcccgaacttgggggcttggtgctgctcgccctgcatttccatcgggccttgaagcttagcttcgcatagttagcgatcaggtacgagaaatgatgaccatgccacatgggtgcccctctgctgtcgtggcgctttcttcacgtccctttgcattcactgccattcactgctctcgccggtctcggtgctactcgtgaacctcgtctgcgccttcattctctccccctcatccccatctcctcttctgcctcgccgactaagcagccccgcgaacgactaatcaccccgccgtcatcatggcgtcctcctctcgttatcagttggctgacattttgaaaattaatcctgcagctgatcaccactgtctcggtctctcgcactcttacaaccgtcgctgcaacaatctgatcagctatcagaagcgtcaggaagctcactccctgattgaacgaggctcccgcgtatttgcagctacctcttccatatccgctgtcgatccgcttcttgtcgacatcgccagcctccttctctgccccaaccagcaccgataccaattcttgaccctggtcgcccagtgggaagcgaaactgcagcggtatctagctgagcagcgatccggcgctcccatcgcagtcatgtcaaacagctactttcacatgccccccaaccccaccatcatggctacgggtagtgggattgcggtcaccaacctgacaaccacccatgggcccggctcatcgagcagaatcaccatccagcatggcatggtcgggatgggtgcaaaccatcatcaccacgtgcagagcccaagaccccgagtcgagatcatccgtcccgcgggcgaccctgttgctgctaccacctcgatgtcagcctcagcttccagcagtgcttccccttctccgcacgccaattctgcattccatcaccgtccccacaccccggctgtccaactcgtcagcagcaccttgatcgcttcgggccatactcaccccgcccatcaaggaagtccgagaccacttccgtctggaccaaacactatatctatgtactgcgactcacctaccgccccaaagcatcatcgcgtcaagcctcgccctgtggatggcgactgcggaatatgtcttctcccgtatctggatgagagtatgcgctgcgacatgtccgacgatgggcgaacggacgacgatgaggatgacgaatgggaggaactggacggtaagctcctttgacttcactaactctatacttgaacggtgctaacgtactgtgaatgtagacgaagaacttgccggcccggactacgatcacggccttctggtctggtgccggggatcctgcgggaccaactaccaccgggcatgcttggagcagtggctcgacacctttgacaccctggagccgacgtgcccgacctgccgcaactactggattctttagatgagaagctggaggaacgaggaaggaggaatgcataccgggagttgttattttctttattactggaattgatatccaacggaactctacgcttctcatggcttaccggagtttacactgggagggaggaacaaggaatatggctatggatatggagttagaggactgggtttacagcatggcttgatatgatatgaacagaaattttcaaatgcagctaataatatgtacagcctaagctacttttgcccatatagtcaaggtaacgcaactaaagcctcgccacccgcttctcactctcccgcccattcaaccactcgagaatagtctccaccagcccatcaatttcctcgaccgtattccccgcatgcagacacactcttacccgctctttccccttgggcaccgtaggcgacatgatcggatgcaccatgaaccccctttgctgacacgcggccgccagctggcgcggcacgggactgcgcagcgagaagataggcgagcgcgggaaatggtccacttcgaagatggcgggatcccaggatccaaggccatccagacggttacccaggtactggatgaggtgttgcaggtttcgttgcggctggtgggtacaagttagctatacactgcaaatcaatgggatctctactaccagaaagtaacataccacttccgtctccccctcggacagcagctcatacgccgtgcgaatcgacgccaggaacgggaaccctaaagccgtggtgtagatgagactgcgggcatagttgatgaggtactctcttgtgtcgggacagcagagcacgattgctataaatcaaggtcagtcagtaaccaaacccactggatctttaaatgaaagagaagaaagaaaagaaaagaaggtgactcaccaccatgactagccaacgccttcccaaacgtatgcacacggatgaacatcttctcctcgacccccaactcctgcaccacgcccgctcccctcggcccaaatgcccccgttgcatgcgcttcatcgaccacaaaatacgcattgccagccgtcaccaccctctcgaccacctccacgaactcccggatcggcgcaatatccccatccatactataaatgctctcaatcaccaaaaacacattcttcttcccgttcctcaccatctcatcaccctccacctctctccttaacacatcttccagacttcggggacagctatgcgcaaagggaatcttcttgcccgcgcgggataaccgcattccctcgtgcgcactagcatggatgtactcatcatgtatgatgatatcccccggttgagggatgcatgagagcacgcctacgtttgcgtcgaagcccgagttgaagagcagtccgctgggggcgttgtggaagtctgcgatgaaggactctagggcttcggcgtagggagagtttcctgttagtaggcgggagccgccgctggcgaagggatagaaggggggtgcttgggcaaggtgggaggtgtagcgggcgcggaagagaggggaggtgctgagggagaggaagtcgttggaggagaagtcggtggaggtttcggggatgagggttaggcggcggagggattgcttggatttgcgccggtggagggcagcgcggagggaggtgcggagggagggaggggatttagaggaatccattgggtatgtgtgtgtatgtgtatgtgtatgtgagggaggagagaggttgctagtgagggcaattgatcaatgcttctttgaagaagaagagaaagagtgaaaggaagaggaattaatgaagcgaaagagtagataaatcgagacgagaatgaaattgaatcccaaacatagtagtagtatcaactattaatctccgggggaaatcaagacactagataactagatatacagatagtagataaaaaggcgaatgtgaaatcgggccagatctccgccatgttcccttagcaaactgaactaaatgaactagactcataatcagttagtttcccatcacaccggaaaggcgtggagagagggagagacagaggggaggggattttcacaccaactgccaactgattcccgggtggatccagcagggcgtgtgcctgacggagtcaattggattagtagtagcttagtacgtagtttaccaactgggattggtattagccagccatctaggtaatctccgaaacaacaattgatgggttggttcatttcatcttcatcgttggttgcctgagcggcagtttttgtttcgattggttttctggtggctctctagcgttatggggcttttcggagcagaccaggaaaaaaaaaaaaaaggtgggaaatggatggatacctcgggacggaaggcagcattagatagtagcaataacataacagaaattgaacccgttcggcggatgttgtgggttgactgttgggggaagatcaaggattcaaccggtggggagggaaactaactaactaaagtactgccctgtattattattatgctgattattctaaatgtcggctggatgcctgattgagtggcaggctgcctgagtgcctcattgattgcctcggctatttttccgccttgcaggctgcatatcccgctgtcatcaatcatccacccttatcttgggaaaacctaaagagtgaaagtgactttcttgatagccatatacttggtacaaaataaaagtaccaattccttgaactcctcctttccccttgccgctttatatatattttctattctttctattcttaattcttccaacttcctccctggctgcctccagccatgccccccgtcggtgccgccctttggcgttccctgcgcgcccaccaggtctacggtgccaacaccgacgtcggcaagaccattgtatccaccgttctctgcaatgccatccaacgcctcaactcccaatccccggctgctttcctgaaacctgtatcaactggtcctttggacgatgcagatgaccggtaagataatcaggcctccaacaattggtaatgtttcaaccccgctcactactagcccagacacatccgacgctacgccccgggcacgctgaccaagtgtctgtaccaattcgacgagcccgtcagcccacacattgcggcgaagcagaagcagctgacggtgcgattctcaatccctccgactctgtcgtggtgcaatgcgccaacagccgagcaaaatggatgagtgagctgacagcagacagattccgcgggatgatgatatcatcggttctatccaccagaccctgtccgactgggcagcaaagggcatcgattttgccctcgttgaaacagcaggcggcgtgcactcgccgggccccaatggcaattcacaggctgatttgtatcggcctttacggctgccgattgttctgattgcggactcccgcctcggcggcatctcatcctccatctcagcgtatgagtcgttgttactgcgcgggtatgatgtgaattctgtgttgctgtttcaggatgattattaccagaatcacgagtatctgcgcacctatttccagaagaagagcatccccctggtgccgctgccgcagcccccggcgcgaccgccgtcgcgggatgcagatgccttggcccgcgatgaggaggccatggctaggtactacgagcgcgtggcgcggggcactgatgtagctgggttgttggaggatatgacagcgaagaatgaggccagaattgagcgcctggaggccatgtccggccgggctcacgagaccatttggtatccgttcacgcagcaccacgggatggcgcccaaggatattacggtgattgattctgcgtacgacgacttcttccagacttacaagcccgcggagccttcacagcagggtggattgcgcgcgacgttcgatggctccgcctcgtggtggacacaaggactggggcacggaaaccccgatctggccctgtctgcggcgtacgctgcaggtcgctacggtcatgtcatgttccccgggaatatccacgagcctgcgttgactctggcggagacgctgctgcagacggtcggaaacccgcgtctgcaaaaggtcttctacagtgacaatggcagcacgggcatggaggtggctattaagatgggtcttcgggcggcatgtgaccggtacggctgggatgccagccaggagcagattagtatcctgggcctcaagggcagctaccacggtgatacgatcggggtgatggactgctcggagccttctacatacaacaagaaggtggagtggtaccggggtcggggctactggttcgattacccccaggtgcagatgtcacagggagtgtggaaggttcagatccccgagagtcagcggtcggccttgggtgccgacctggagtactcgtcgttggatgcagtgttcgatctggagacgcgggtcgcctcggaggtcggacagcgctaccaagagtacatccgggggacgattgcagagctggtgcagcagcggggcatgaaatttggctcgctgatcatggagccggtgatcttgggagcgggaggcatgctgttctggtgagttttctcctaacagttgcaaacaagataggtagtgtacacgccgcatactgaccaatcatttagtgaccccctcttccagcggtgcctggctgaggtggtgcgcggtcacccggagctctttgcccctggcgccactgcaggcgcggcgggaggatcgtcgtggtcgggactcccaatcatcttcgacgaggtgttcaccgggctgtaccggctgggacagcgatcgtcggcctcgttccttggagtggaggccgacatcgcggtcaacgccaaactgctgacgggcgggctggtgccactgtgcacgaccctggcgagcaacgaggtgtttgcggcgttttcgagtccgcagaagagcgacgcgctgctgcacgggcacagctacacggcgcacgcggttgggtgccaagtcgcggtggactcactgcgcacgatgaagcagctggaacgcagtggggcgtgggagaagtaccggcgggattggcagccgacggggctcccctcggtgccccgggcgcgaccggaggtctggagcgtctggtcgcatgggttggtagggcagctgtcccatgcgccggcagtggaggggttgtttgccctggggacggttttgagtattgccctgaaggatactcagggcggaggtgagtttggatcccatcactgattaacctttaacattttcgtttgtttattggccgagaatagccgctaaccggaggggggtgcctcggcaggatacacatcgacggcggcccaaggactgcagcaacggctggcagcgggtggagagcattttgcggtgcattcacgcgtgctgggcaatgtgctgtacctgatggcgagtgtcacctcaaccccggaggcattacgggagatcgaggaagtgctgcgggcggcgttgttggagtgaaaaagattcttccgagatctgtacttatggcttgcatacatacacgatacaaacgatggatagaaccagtcactacttactactagactagtatgtaggcatagatatgacataacggacaacaatgacattgtgattggcataaaatgaattaagttttttttcccctgtgattccgatcctcgttgcttaacaatcgcgtcttcaccgacggcccgaacagagccagaatgtttgggtgagaacagccaatcagcggcactgtgatccgaattgctgcagcggagctcctttggtccgtaacaagtggatctcatcgtcataatccatcttgcaaggtattgagggagtgagggagtgagtgagtgagtgagcgagggagtcagtgtgggatgctcccagcaaagcacatgcagccaagccaaccccccagccagttctctccgagtacccatcatttctcctatgcctaattttatctcaatcaagagttgatccatcaattaaaccaaatcatctcaccgaacacaaagtcaatcagctcaatcaacaccaccatctcttctgagtcaaatcagccaacttgtttcctgctacctgggatgttgtggccccgcgttgaacaccaccacccggttggggtcaacaagcgtcgcccacccgcaacactcatgcttaatttcttaattccattcgatcggcgctgactggctggccaactatcatcgcccagtaatgttaatccggttgttgtgagatgatagtgctgtgctggtgcccctcttttcacccgaggtgttagttagcagtatggagagaggactccgtagtaactatttgactagtaatttgttaattaatagtgtgtagcctggaacagtccctgcctgtctgttccctcactgtcaacaatcatctcccctcttctctctccatcttccccagtaattctctccatcttaccaccacaccacaccacatactactcccgcatctacacatctatacacaacacacacacacaaacaaagacaaaaaaggagtaaacaatgtctctccgtaccctccccggggtcctcctccgccgcagctacggcaccgtgcagtccaccacccccagtgccgccgccatcgccagccgtatcccacctgctctgcgtgaagccactgccgccacggcaccacgcaccaactggacccgcgaagagattcaacagatttacgagacgcccttgaaccaacttacctatgccgctgtacgtccataccctttccccctccaatctacaccaaatcacacaatattgtaacactcactaacaataatctaaatataggcagcagtccaccgccgcttccacgaccccagcgccatccaaatgtgcacactaatgaacatcaaaacgggcggctgcagcgaagactgctcctactgcgcacaatcctcccgctaccaaacgggtctaaaagccaccaagatgtccccagtcgacgaagtcctcgaagccgcccgcattgccaaatccaacggcagcacacggttctgcatgggcgccgcgtggcgcgacatgcgcggccgcaagaccagcctcaagaacatcaaatccatggtctctggagttcggggcatggggatggaagtctgcgttacacttggaatgatcgacgaggcacaagccaaggaactcaaagacgcgggactcacggcgtacaaccataacctggatacatcaagggagttttacccggagattatcacgacgaggtcgtacgatgagagattgaagacgttggaaaatgtgcgggatgccggcattaatgtctgctctggtggaattttgggtctgggtgagaaggatgaggaccgcgtggggttgatctatacgatgtcggggttggagaagcatccggagagtttcccggttaatgctcttgtgccgattcccggaacgccgcttggcgagaggaagatgatttcgtttgataagattcttaggacggtcgctaccgcgagagtggtcatgccggctaccattgtgagacttgctgcgggcagaatttcgttgagtgaggagcagcaggttgcttgttttatggcgggagctaatgccgtctttacgggtgagaagatgcttacgaccgagtgtaatggatgggatgaggatagggccatgtttgagaagtggggtttctatcccatgaagagctttgagggggagcatgttaaggatgaggtcaaggtcaaggaagtcgaggggactgcgcaggccgcggttagtgcgtaaatagttagatgaattaagatgattatatcggttcaaggcttttgtatttgaatagcatcatgtgacttgctgttgttttgattatccagaaacacatgactcgttcttcatgaacagtatgcacaccccaagtcagtagtctgatcatagagtctcacatcctcttctcccatttcaatatcttccctgatatatgcgacaccataacatcaagaatatccatctcaccacaatcaacccaacttccaaatggttctttgttcttatcatcatggttagacacaggcctgtcacttcactactatcagtgacaccaagaaaagattgtcctaccagcagaagcggtttcccctataccccaaccggcaatagccgctggaacaggacagaaccgaagtattactcgagttcaagttgacgccgagacacatatcttgatcatcacccacatggcctacatcagccaatccctcgttattcgatcccaacacacccacacagcgaccttcgattttctgggacccagcagaaagtaaaagaagcactttctgatacagtatcccaaatcccaggatatatgaaatatcccctatgtacttatcttgtagtctctgttcaccaccacaacggtgtggcaagagaatatgcatcaacccatatgcagggttctcatcgaggcagaagctcgacccagtgcttaggaatgtcgctgagcccatttagcaaggcatattcccaacgtatatgtgcgtccttgcttattcaatatactgaggacaaaggtgaatgctcttttctgctatagtctggccatccgtgattgcaaatttccagaaagaatgacccatttcgggtttcatggaaacgggttcaagaacttgccgaatgatggagctgctagcaacattatgcgtggggtcgtttgaggagcccgtcgactcctgcgtagagattttgagtagaagtcttctcttaatttaaaatgggaaatttggccacgatttcgtgatattgatgtcttcgtccgctgccactttcgtacattcccagaggaaataaggtagatgcaccctgaaaagttgctctttgaacaacgagaacgcagcatgacgagagattatatctgtagttgcttgatcgcttacagagtgagggaacagaatacctgtctggtcgccattcctatcttgtggttcgtcgtccaaacagggactgagaaccctttccatttttcatcagtttgtactctaccatagtagaaataccggtattgtcagaagatatctggcatgtcgcagtggaattgcgagatggcattcctgtctttttgatcgcttcgctggagattgaagctgaatatgctagtatatatattccttggaataagtttctgcgagatagcagtctcagaacgacaaggttccagcttgtcgtcatgtttggacctatgttcctccaagtaggagagaacggtaaggcggcgagaaaacagtggttggggagtaggcgattgcgctccgcagatcagggagccgactgatcgactccaatttagcttggtggctgagatctggacgaggagagtcacgtcttcgggatatgctcatcattatatgtaacgcaggggcttatccgtttggcagtgacgcaggagattggaagagttgtaataggtaaagcctatgctgttcacagaattgtcttgagtgcatacgcacaatgtttaggtttccaagctgcagaactcctgggttgagtatccatatacagtgttctggaaccgtcggtgttcaatgcgccccattgtgccgtttatgttagattaacatattgggttctttgattgagagatcctttctcgagcctgtttgcgatgtatgatcgaatctccagcaggcaagcagtatatgcgatgtattgccgttgacatatgttatatgaagatgtaccgaagtctgctgtcggtttcctcctctgactcgtcacttggcatctgcacgaagtgcccaagtctgaaagagcatgcaggaaagacaaagatgcattgttgacgcttgtaacatgtacgacagatttatcttcgcctcaaggcggttataggtatagccttcttgatgaggcagacagttcggcgatggtctaacttctgccaaaacgagaagcttctctgggggtattcatgctcgggacatattgccaatagacagtagacgccacagtttatcagtctgtaattgtcatctttattttgcgagtcttgcgcttttgctagtcttgcaagacatgttccatagacttggtggtattcctagacgtgtcgcgatatcgatttacgatgtggagaacaaccagttggctcactagattccgcataaagtcatcgagtctatcagaacctttatgacacagtggtaagagtgtatagtataagagcaaggcatctatgctctcgctggtggattgtggcagaagaacgaatttctcttcatggccgatatgctaatagctgaaaagctgttgcgcagctttcaaaggctagggttctgtctgggctttcttttcgttgattagtcggcaccaacgatatgtttaaacttgaactggtcactttagacagctctgctattctttcatgaatctcaggagcaccgctgatgaatccccatgtcttttatcagatgttgagttactgaccctcggagagtgcatagttggagcttgccgaataacctcatagttgtatgaactttctgtccaagcattctaaatcccaaatgacatgaaaccaatgaatctggaggaagcccttcctccttccgctcctctccctctccacggacgaacgttcttcaataaacccgtccccacaacgcccgcgtagccaggaagacgactcaacactcccattgagttggatatgtagtgtgggtagcgacccgacaatccaagtatgcttccaagtctgtagacagtgtatgaatatcgccactgagctatccggtcccggcaacacatattgtcaatgaggacagtaattggtatatacactcgtagtttgctttgatcagcttcttcgtgtgcccggctctgacttggtgtaaataagtaggcaaatggtgtcctgaagacattgaagcggcgatcataaacattcagttcatagatgatgaaaagattcttccttcttcctgcgaaggatgtcttctcctttgggctcccttgattctgtcattgtcttcgaagccaggacatcattcgcagagattgcttctttatatatacctccgctctttctgtgtcaatagagacactgcagataaagagcgcaggcccactctttggccgttgtgcagttttaatatataaccattaggctgtcatgtccgcttccactttctcatgcgacatgcccacgtccgtttgcaggaatgccgacacctccccgaggtactggcgttgattgatgtcgggctcgctccaggcatccatgaattctgcacatcgtaatagccacaacttgccatatcattatccaagagaacaggacacagtgctagcctgtaaatcagacatagcacagtgatcccgcaacagttgctcctttctgctaccttttgaggcaatttggtagagcgggaaccccggccatgcttccagaacgactaagttgctggagcatctctcatgctcgattgaccgagtgcttggaggaggattgtaatatcgagctgtacagacacttagcgtttaagagtgtatttatacgcctcagtatcgcgtcctgatgctttccgaccagtgtctcagcgcattagtcctcgttggtggctcttcagtttttatgatcttccgacgtttggatctctcgagcttgagggggtatcctcaatttccatatcccgagaatgtgctcaatataaggaacatagagttgtatatagttgacttgctcaagaatggacgcattaaagtcgtactggggagatacgtaaggaatactgccgagtggattgtgaaagatgcagttatatcgagcctgtcatccaaattgtgcaatctaacattgcttcggacaccccaagagtcgagctcaacagctctccccaaccacataaggtagtattagggttaacgataggtggccaaccccggacctgtctgatcaagaggagaaagtcttggaaagctgggtggtatttcaatagtaagtttcaacctttccattagtagaatccctgaagaacccgagacgcatcaagatctcttggcaacttgaaatggtactaagaatgaatggtattgagaaagaagatggtccagtgggtgtatagttcgcatgccactctagccataagttagagggaactagtactactttatcttgtgaagtcttacctctgggaatctccatctctccgtgcaatcggcgatgttaagataaagtgcctaccaccgtatgctgtctggatttgtaccgagatggtttgaatcgctgtgcttcaccagcgccatgactatacatatcgccagttgattccacgacagtcgtacctgccgggaatttccaggaagcaaatagcgatatagcctcaggataggatcttgtaggggtacaacattctgcacatgtgaccaatagggtcgtttcaaaatatatagtttagccctatatgctatgcaagtgccgcaagtggctatatgtgcttcgatggagaatagaagaatgataaggaaggaaaaaggaggaagaagaacagagaaaagaaagattatatagtagataacaggaagagatctattcatcgcaccaactaccaaatagtgaagcatgatatcgtattcatcctccccagtcaataccccagcccagtggcgagcaagaatagggaatgttgtaataatcacaagccattcttaattcaatctgctattcccagctgcaacatgatccaaacgaatgtgatgcatgatgcaggtatgccgtgacgttgaggggggatcggcaaatctatcgtatgacgatacccgatcatgccataatcaggatactctccactccctcaacccgaaaataaggtgatcctcgggaactccccccatcttataaataaacctttagtctagccgtcactgaatcctccagtctgcgcttcgcacttatcaagccaaatcaactaaactgaacctcaaatcatcgctacaacattaccaaccatgaatatctcggcttctccctctggctcacagcccttcatcaagagacctgctctaagtcccgcgttcaagaagcctagtagatggtgagtgtgccttctttccccagatgacgtattgaataatagctaatgaatacaggtatctcccgctcatgggcgtcatagctctcggtacattcccttgcgatacatgaatcagctcccaccatctaaccattaactataggcttcggagtcgccaaccacctcgaaaaccaagctcgccagccccagttcgaccgcgaagaagaggagcgcctccgaaagaaccgagccctgatggacgcctacggcgacaaagaaacagtccaagatattgaacgggcgctggtcgtctatgaccttcagtgaacatccttgatggaaggggaccattattgcagcacacttagcgtgggatatgattacggctttcatgaataatggtgcataaggagtttgggattcattttaactctccggaagagatgaggaatggtttcgggattatggaattaactggggattttgctggtttaggtttcacggaatagcatcttgaattgagaagcaatctggttattgcacttatgctactattttttttctatgaatgagtgggattaccgaccgaatcgtgactgctgtagaagtgctgttctcgcaccccccaaatggcactggagactcaattttcagaccaccaaccgatcattaccccatagccgccacggatgcggggatagccattctgtagcccacccgccaatcacatcgtcacacatgctatcccgcgctgtatggtgtcgatcatgatactcgactcctatctaaaaagagctagactacccctcaagtaactcaacacagcccctttggtagctgcagcttgagctgtgaaggttgcgcgttcttgctgcacaagtaattcagtgcttcataggcatttataaattaaccctgctgcctacacctgcactaagggcagggaattgggtatgacccgtcacatagctgtttcaccgtagtgtgctgtacattttacggatagatcactcggcacataataagcgggtaaaagaactcccgaacattgcctacgaagggcgccaatgcagatcagtccggcagttggcccggaggagtgaatgccagtccttattcagtagagggctcaagctgcctggaccatcctatccttgggatccgtacaggttttcataacttgcttattaaaccctacaaataatgctcaaccaacaacaccttattcgtcaggctcccacgccaacactagatgcagtcagtagacgattctttgccaatctgcgaaacaactgcctggcaacatatttacgccggggatccgtagcggattctaccgcatcattgtgctgatgctttaaatgctccatatggagttcagcaaggttatcagaataggatgaagagatgctaaaggtgctgcctggcaaagctgaccgtggtagcgtccccagacggacaagttcattcatatggagcgacaggggtctgctgtttacatcgtatgagaattcttcaagacgctccatagacccaatttgaggtagggaaattctgttcagctgcaggagtatatctgcaaactgtccgtacatcatctccagcttctccacgtcaatgttcggatcgggtaatgacggtctgatattacgagcccaggcgtggccagtacgtcgctcattgtattgacgtgatcaatatagtccatgacgatgaacggaccaaaccctggggggctttcttccttggtaccgcagtgcaggatgaatggcactggaatcgaagtattgtcctggatatatcgaatcgctgcaactctttgcgaactttctcctcggggagaacatgtttactccgggcttggggaaccgtatggttgcagagacgccgtcaagggacttcatgcggaaggttatattgaagtatctagcgctagattggcattattcgtctgcaacgccttttcggtacttcactatgaggcggccgattgctcggagggtgtcttcgtcggcgaagagattatgtatccaactgtctgcgatgtcttcgcttctttcccaggcagcatcgtcgaaatccatgcgtggatccattgattcattcaaggttgctgtacaaggcagaaaaagtgattggatattatgtagatagataaagtgtataatagattctgggtagaaaacgctcggggggaaggggacttccgcaagtgcgatactatgcatcacagcaccaccgagatgtcgatctggaaaataatactaatttgtactctgtaaacaaagccccacgcacccaattcgtcgacttgctgaggtgaggtagtatgtaattcagccacggagaatcaagactaccaattgagaggtttttgccatcggtaaatgcctgcaaattctacggtgacagccacttgcccagggtatattgctaagtatgggcgttggcgcttaatcactctggattcctgcgagcgagacgatgaaatgccgtgattccaacgataggacccgatgttaactcattccctttctgactcaataccataaacgactgtcagttggtatgtacacgggaaggaaggtaaatgataagtagggtaatgactaggaaacgagaggtttatttcacaattcaatattagatctactgaatcacacagccttcctactctgtcttatttcggattctattcaaagttgctgcagcttcgtaagggcgattgccgtcgtatagttcacgactacggatatcagctataaaattcatcacttttcctactactctccgagatatataaggggctttagcagaggtttctgcgttttgatcccaatttgaaaagaggtcctgtttctaatatttttgcagcttatagcataggtatagatatcaaaatggcatagaaaagtagaagtttatcactctggtaccgttgctttgtaccgatgttggtaggagaattcctttactcaccacaatgcgtagatatcttccacctcacggcacattatactcatcggcaccaccctagaagcacttggtatagataaaaaagctgttgaacagttcttccaacccttgagataaatatccccttcgtcctcttcgacaaggggatcccaaccagagataccagatcatctcatctgctatactcagttctatctcttcgcattctcataaggctaaaggtcctatcaggaaacttttaggcttacttaccattgatttagtgatccagcaacaccactcagttatcatcatggctccaggcgacaagaacgcaggtcgtgacgaagctgcataccgacttaacctcggggaatcccaggccgaagctctgagaaaacagggtgtaaggtcaggagagaagcgcggaaagtcctacgaacccagttctctcaggttgccaaacccgcatgaagaggaccagatggagaaggcggcaaccgcgtcaaatcagaaacggactcatgttactgagaagattgctaaccaatacagagatagcaggggttgataatgcacatgtcactgtcaatcatagcttgttgaaacatgcaggctcctgaatgaccaccttgatatgtgccatgagagaggagtttataaagggacaatgttagctgcttttatatcactagttatcagtagtcgtccggctagagtgtaatgtccatgtatggatgccattttcaattacttgacctaggacaacgagcctaaaagcttcggtgcatatagatgaagagaagtaccccttggacaaattgttagttgtcagggctggcctatgtaaatgtacttggtaaatgcatgtggcgctggaatttgcagtactgggattttccatgatagatgatattgggatccaatagaatcgttttctatcacatataatgtggtagttgtccattaccccagtcgtataatatcaagtcaccttatcagaaaacatacatcctcacacaaggcaggataacatagtagaaggacctatgttgttaaagtgaagttctaactaatatccgaaggtacataagttgttatcctcaaagcaatttcgcagagtcactgactctcgcaaaagtgatactcggaaaatatccaagtcttgttcacgatttaagggatttctgtgctaccttatagaggtcaagatgcaatagaggcccacaaagctgaatgcagttgaatgcccttctgacacatttctaagtccaattaccatatcgtgtttccctgtctaatagttgaggtctcggattacagaatgatctagtctcttatccgccccggcgaagcgtagtggtatgtgggaatcacgacaatgctgaacaacccaaacaataagctatagcagtaagcatgctatcggatgcttgctccctgataccaatggattccgttcctacgctgtcttaacactcgggcaattcgggcaattcggacatcacgggattttcggtcgtaacggccgtaacggctctatcggtcatttacagggctgcctggctgaaggaacagcttgaagatgatgccgttccaatgtaagtatataaagccagtgcctcttgtttgtcctggatttcttctcatctttcatttctatcatcctcacaatattatcccgaggtaaagacaaatcatgtccaaactcagaattctcatctgcggcgcaggcatcgccggtaacgcccttgccttttggctatccaaactcggccacatcatcacagtcatcgagcgataccctggtttacgagccaccggactccaggtcgatctccgcagccctggcattgaagtcgtccaacgaatgggtctcgagaaagcctttcgcaaggtcaccgtcccagaacaaggtctacagcttgttgacagccgcaaccggcgatgggggtatttccctgctaatcgaagtgggaagggattgcagagctttactaccgactacgaaatcatgagaggcgatctgtgccatctgcttcatgacgctgttaaggatcgcgtggagtatttgttcggaatgtatgtcatggaaatgcagcagacggataattttgtcgacgtggtcttgtccgatgggaggaaagagcgatttgatcttgttgttggtgcggatggtctgggttctcgtatgaggaccatgatgcttgggggtggggatgatgatagagattcggttcactcgattggggtctctgctgggtatttcacgattgatagggaattggagaagggggagggatatgatgcaacggtgtatatgactacgcaggggcgtgggatcatgatgcgtcgtcataacccgcacaagattcaggcgtatatgttctgcaaggcggggccttttgagaactgcagcaagggcgatgttgagcgggagaagcaggttttgggccaggtctttcgggatgcagggtggaagtctgaggagatcatcagaggtatggaagaggcggacgatttctattgtgagcgcatgggggtggtgaatctggatagctggtcgcgaggccgtgttgttttggtcggagatgcggcttattgtccgtctgctatgacaggaatgggcacgccgtgtgccatggttggtgcttacattctggcaggggagataggaaaccgttgtgcgaaggggattggttccaaggaggacatcgcggaggctttcaaaacttatgaggacaagctcaagcccttcatgttgaacgtccaaaagggactcatggacgatcacgattacatgagcaggctcccttcatctactttggggatcactgtggtgtatatcctgtttgcaatagcctcgttcttgagactggacgtcctctcgcaatgggtgttgcgcgaagattgcaacaaggactggaaactgccagagtatccgatcatggtcgacaactgataaacgtcgggagttccggcagttatccggtatcgaatggaatttgtgttgctgctgagcgtgttttgggttgtacatttagcttcatgtgagattattttgttgtcacgcccaatgtaatatcttctctccttaatgaataccagtctaactttaccaccccgcaaagagttgcaagtcaggaaagtcgaagttgaagtcgctgccgtagatggaatcgaaaccacgatccaagggttccccagaaacatctgatctattgagactatctccaaaagatgcagtatcagggccattggagatagatgccatagctaccatgtcctgcatcataccgtagcacgcatccacactttcatgcattgtccttgaaactgcctcctcctcggactgaccactaagcctagcttccgcttgggctagcatcatattgtaaaagatatagactttgacattagtttctccatgatatattctatctttcgcataatgaacgacgcagcgggcatctcgcaatagggttccctgacgagcataatctcttcttttcgccagactcgaactctccgcttctggatcggggctggcttctgagaagatgagtattgccgcacgggtcacaatgtcgcgaaacatgccgcccccacaacggaggacacgaccgtacaagttgtcttcgaccagtgatatgatatctagtgcggcttcaacaccggccttgcgggagtgactgtataggggattaatctttgccttaatggcaaatttgtagtggagacacaaggtaaagcgtcgaatgagatgggtgcagaagcttgatgcgaattgatctaatggggatgcagagtcaagttggtcgagagtgagcgagatgtcgcggcatgctgaggctaattctttaccgacctcaaggacctcctcgtagggcggttcctctcgcaagtcgtttatcagtctggaggcatgcagacggagtggtattgaacttgacagtataggttgcaaattcattgacttatgagccgctgactcttcccgttcgccgatctctggctcggcgtcgagattgtgatcgcttggtggctcagtattccagtccccagttgcgatcattggtaacattccggaatccaaggacgactgtaggttcaattctaagatagtgtaccaaagtcgccgccttagtcccttttccgtgggatccatctcactcagacagttgggatcttgatgcagacccatctgcatggctatcctcatcaacgagcctgtggatatccagatcagatcggcgccaacctgatttacttggcgggccaaaagaagcagacagtggagttgaatgccccccaaagttaagcggcttttttctagtggtgctgagagccatgtctgggcagtataaatccacattgcagcttttgacgccgcatttatacggacattggcatcctgatgcaaagggcctgcgatggagacgacaagaagaatttgtaagactatacaagtatccgcggattcgtggttattcaggtatgtctggcaatgtgccatgaagggattcttccgaagtattcggtagcacgactcgaatgtggcgaaatagagctgggccaattcaaggatgacatcgggactaggaagtgactgatgaatctgtgtcggaaggctgctacgactaggtctttgacttttgatacttcgagctagccttttgcattgggccatcttatcagcgatggcatccaaggggccgtggcttgtgtttcgtatgataatgtcgtataggcccatgagaggttgcaaggtgggcagcccttctgtctgtaacgccgtcaataaaagcatagtttaatatttatgtcagctacataccaatgaaaaaatattcatccaatgtccttggccgaacactctcgtctttgacaccatgcctcggatctggcccgaggttgatgcagcctgttgcgatgaagcgtgaggtgtgtgcgagggttggccaccatttctctcctgaaaaacatgttgcctctgatagttggtttcgctgctagtaggtggcgccgtttcacgattggcaaacgaattgcgattctgctcatatgtacaggctgatgcattattctgggttacgcactgtcgacacgggttggcccggtcgcatcggactttgcggcgacgacacgcagtacatgagaacgccgggcgtctgcgctttcttttattggacgatcccggactggccattgtacggagtttatgattgaagggtgttttaaggttgggagtctgctctgcagtgcgacatgaactgcaggatcgatcaggaaagttggtccaagaatgtttgggactgtcggtcataagccatcttggcccgatacgaccgatgaggctgagccgtgtccgccccaggcatcaatagtgatcgactcgctttgaccggcttacgaaactagaaaatgacattttgcaagcgtatgttgttgacaatatgaccagacgtacgtatcacgtagcatactgaattataggctttctgtaggcatgctcttgtctcattaggatcgacgggtgtccggttaaattccaaggttcatcctccaaatatcttgggtatgggaaatgcatagcgctgtcgacgcaccaagcggggcacgttttgccacggatgtccctcataaatctctctggctcagtcgctgcatctactcctctccacaacaacctcatcgaagtatacctgccatgtgtacgaattatcagacgacgtgcacgccgcactgattgtcagcacatccgctgacctgttggccgtgaattccccattcacagcagtccactgatcagtaggttcgagatcagcggtagcaatcgtatcactggttgtattcagtcccaagtacgcggcgatatggcaaaactctgctccagaggcagaaggctttacttggacggaaaagttgtaggttgagctgcggttgagattagaccgggtctgggagaaggaattggggctgttgtctatagcagttgtgaggtcgctgttacacacgttagagattgagacacaagcagaatttacacgaaatacagtgagtaattgccagtgtaggcgggagtggcagtcgtgactcgggctacatttgacgccgtgatggaccatggcgatagagagcctgtctcgaaggagggatttgagaggatattacacctggaggtggtcgttatgggctcacggtgatggggtccaatccttacatgtcatcaggatagcttgagagtatagcgaggaagcaacagacttattgcactcccagatgctctactcagtttggcataatgctcaccgcattcatcggttcgaataggaatccggcttcgtggtcagattgatgtcatgttttgcctctgtcatgtacctgtcgttcttgcaaaagctgccactcggcatactccatcactgctttatctagcggacgatctagaatcatacacgcagatatatatagacaacataacgaaggcatgcgatatcgccttgacaaatggcctagatctcaagcagatacacaagaatcaagacgcgaacttctttaccaaccagtgcatgataattgttgtggctcattatttcgtcgaagagattcaaaggtggtcagatgactaccagcgtgtaaggagtatcgtaaatagaggttgtggcatcctcatgttacgcatgtatgtattagcagtcacattatgcacagttcaaccttcttttatgcagcgtaacttttgagagtactggtaacagcacatattatcaagccaataaatgcaaagcacgacccgcatttggttgggcctgaatgcatcagtgactacgttgtatctgtgaggctgtcatcgccaatgccaatcaaaggctgccacaactatctcacttgtaaaatcacagaataatcagcaggaccatctttagatttatcttgcttcaccccccacttcaatgatcctgctacgtaccaaacaagatagtttccagtattgatatctcgcaacgaacaaccatcatggaccgagcgactcacgttatcgacccagacggcgaagttatgatagttctacaaaatccaaatgccccttttgcagaactaggtgaagctctgaccagcgacaatcttgcatatacccttcccggaccaagcgatgaaatccagaactcggccgaagggatagaagctttgagaaatgagccgactaaagcgcccaaaaagaggaagaagaaaaagaagaaagtgtctacttctggagggcgtgctgtccacattccatccgaacctattcacctgtcaattgaagagtctgctcctggatggcccgcggccgaagcacccgtcgcagagcccgctgaacatcctgctgaagaacccgctgaagaacccgctgaagaacccgctgaagaacccgctgaagaagccgctgaagaacccgctgaagaacccggcgaagggcccgttgtggaggaaaactgcttccgcatcctagtctccgcgaaacatttgatcctcgcctcctcagtcttcaagaaaatactcactggtgggtggaaagaaagcattacctatctacgaaaaggctcggttgagatcagtgcagatagctgggatatcgacgcgctcttaattatgcttcgcattatacattgtcagtcccatcaaataccgcgtaaactgacacttgagatgctcgcgaaagttgctgttttggccgactactacgactgcaggaaggctgtgatctttttcgcagatacatggatcaacgctctggacgaaactattcccgcaacatattccagggacttgatcctctggttatgggttgcctggtatttccaccaccccgccaacttcaaagaagccacctcaactgccatgtctttaagtaacggctggattggtaatctcggactcccaattcccgaaaaaatcattagtatgggcgcttaaatcctcagatacgcttgactactaattgaaagcaggatcgatgaatgataaaagacagggagcgatcgctggcctaatctttcaacttgaggaaacgcgcgatgaactccaaaacggcagtaaaggatgtggcttcgaatgcagctcaatcatgtatggggcactgacaaaagaaatgcatttgaacgctctgctctcgctgaggcctgtagctcctttcccggatctgaactacagatccctcgtgcaaaaagtgttatcattcagatcgccggtatggtacggtcaattttcgtattattccagttaccaacacaattgtcaatattccacattcaaactgctttttgacgtgttggaagataccattgaaggccatgacctgaaggattctatcaaggtgtagttaaggaactaccaaacctagcttgtcgttgatactttgtcgcctaccgaaacaagcgtcttcctgtccagccagtcgctggttgatgtagtagagatctttgcaaatgcgataatggagacgaaagcgacttgtactaataccacttggtattcttacggagcccttgtctttggtcttctcgctagacaataagagttggtttcctctagatgacaagagccagagctggacaaaccaataattcaccaaactcagcaaaatatgtatcttcagtttcactcaaccgctgttcatctggccctgcagttgtaaaggtcatcgcgacatcggaatcgacccataccatccgctcttcttcgccagcaacgagtatgtttttggggtatatatctcggtggtgaatgtgagcaccgcgtatctgcttcatgccctctattgcatgatgctagcaggcctcagaatagttctcgcaatttaaactttccgcatttaaaaggtattcaagtagtattgctctagggtgatataaatcgtgcgcaaaatgttgaaaagctgggtagaacgcggtagggtcgactcgatcaacgtggccgtagaagaatgtgccgaatccccgctcgcagacactgtgttccctaaaattcatttaggcgtttagttctcagcagaaccaattaagatctcgactattctcggcaaatcctggatccccgttgtcgtgaaaccaagtcgtcagtaacaagcaaagagctagtagcctcagctacttacaagcttcatagcacatttccgcctttcgaattctatttcaaacattatggagacgcatcaaaacaatcgatttctcttacaatccgtatattggcagggaaaacgtccaacgagccatgatctctgagcgtatcgtcgtttgaagagtccattgagatgtggtcggcttcaacgagctgcctggctctctgatgacgaataaactcacgtgaaggaccagaacgagcgtaatagagggaagaactatctggccgaaatctaccccgcatcttctggccgggatctcaacaacggatccatgaaaacgatgacatagaagtgtatttgtcaaggatgactattcatacactggcccctcgccctagggcgacattcaggggtccattatctcgactccctatgagcatatgcacgctttgatcgtgaaccattactttcccgatgaaattagagccccgtcaagtcctgtcaattttaaactgcccctaaaagaatagactaggaaatctgaggtcttgaggtagtttatatatacaactgggactctttaggaatctcaatgcttccacgatcactcattttagttcagatatattcatgttattagacatgccatcaagtgccatcgcatggattacgtgtcattacagtaccctatcatatccccacaaaccattctttctaactagttccatgttaggcctagcgtgactacactttggggttgcagaaagaatcgaagagtgcaactggtgacaccagtatccggaagccctgtaattatcttctgactgcagtagagagaatagagaggcctttgcgggcaaatctctccatagtgtgctgcctaagctgactaacagttgcccgagatgagaatgctaattgcttatattcatattgttcgagttggtggatcccattcaatgaccatctactgtcgtggcacacgtcattgtcatcctttgcgtcatgtttgtgaaagatctccggattgtgcacaatttatctaccagaaacatgtaaacagagatccctaattgctatacagtggagaaatctctctagttcaccgatagcccctacctaatacgatagggacggtgggtaagggaaaggccaagcttcatagagaaggcttgatctgaacaaaataggttgccaacactcaaaaaggcttaacctccgcaagttaacgcggttccagtggacacgacgcgttggtccgtggggcggattcgttgagaattgacgaggatccatctcgtcgatcctcgagtggggaatgtccagatatccccgacatgttcttgaccggtagttatctacccttgcaaagtagcaagggaccattaattacacgctaggaatagaccgcagatacgatgtctcatagcagatctcaaagaacatgctacatcacatttccactagcgatctctgtaagacgatgtgggtgctgaaggcactcaatagacctgtgacaggtttgtctcgaggtgggttctaagcttcggatcggcaggggagtggcagatttcacgaaacgcctcacgcgtcatttcaagacgatcggacagccgaccatgtatgaggattcgaactgcttattctcggagcagggcagacccgacgggctcccgaggtggcttggtgatgcgtgaacccgatactagctataaatgcgtcttcaattcactatggccgacaggatagacagaaccactgctagccctcatccctccatcttctacaacatgggtccttcactgggccttgccgcatgggcatcacttctaactgtcgtcagtgcgcaattcaaatgcagcttgcctgcaggtgatatctgcgcctacgagaacgccaccacctatgcggcagtcaatgcgcccaattgtaccaccagtggcctacaagccttcctgaacaagcttcctgggctcgaaggaacaacactgagtgtgccatacgcgttttacatcgacagcaatgcaactctcgacgagttcaccgactatgtcggcgcctcgacatttactaccgatattccatctgtatgtgcgtttcgagtgaacggaacaaatgaacagggcgcgacttggggtttgggagcgcttcttcccacccacttcaacggcagtatcatgtatgtataacccctcatgcatctgcaacttgaactccttactgacgacctccaggatggcagcccccgactccggactctcatggggtgtagcaagtgcaggtctgcgctacgccttcgccaccttcgcctctaactccggccacgacgagccagaccacactcccggctgggagacccccaacggtctactcgattggagccacagagcactgcacctgtccaccgtgaccgccaaagccattgtcaaagcctggtacgacgtggaacccaaatacagctacatcaccggctgctccgatggaggtcgccaagtcatgaagtctatccagacataccccgaagactacgacggtgctatggcgggtgccccaacctggtggatgacacaccaggcattctacgactacaagcagacaaccatcggcggctcagcccgatcaaactcctccatcccgccctcactgtacccagtcataacggatgaggtcctccgccaatgcgatccccaagacaacctcaccgactccatcatctcgaatcctcgaggctgctttttcaaccctgaagccctagcatgcagcagcaacaaaacatccaactgccttaccgcaccacaactggacaccctccacaagatatacaacgactggaccaccttcgaccaagacctcatatacccgggtgcgtggttcggcagcgagcccacctggaacactaccttcggcagcccgccctccaagtcatggtacatcgagaacgtcctcggcttcaagaacttcacagcccaggacctgacatacgagatcatcgccgaggcagacgcgcgtgaccccgcccacgcaaacgcagacgacttcgacctgtcgcctttcttcaacagaggcggaaagttcttccactggcacggcatgtcggactccgtcgtctcaccgggttccagcgtgtactaccaccacaaagcaacgtatgctgcgttggagaaggttatcgatatcgatcaacattatcagctttacttgattccgggattagagtgagtcattctcctcccccaacttcaatcttcaacgaaaccctcgaggatataaaatctaaccaaatgataagacactgcaccggcaccccctcctgcatggccgctctatggtacctagccggcccataccaagccgggaacttcttcaactccacccccgccaatgtcgtcgacaactacgttcatgactctttcctcacgcttatcagctgggtggagggtggtcatgccccgtcgtatatggttacgacgaactttgaagataacgcggatccgactacgctgcttcataatcggaagatttgcccgtaagtaattgtttcactctcatagatagaataggttgctaattgggggtttcaattaggtacccgaaacaggcgaactggacgcaaactggtgtgtcgattcatgaggattactgggattgtatctatgtgtaaatatgggtggagatgtggtatttgcggagattggttgtgttcaaagtatttatgcttagatacagataggatataactgctatagacgctgaggcagaacagatactctctgattcgctgaaactgtactatatgtagttggaacgctaatagtgtaagatcagaaagcaaagaataaactaaaatagataaaagcaaaaccgaaagaaaagccaatgtaagaatcgcagtttttgttcaaggtataatccagccatttatacatccaaaacgccatgctctgcgctcatgcaactatcagacgcatttacaaacgtatatcgtatcatgatccaatccacttccataaaacactcagtagttgatctcggtgaaccggtttaccgatgcaatcgctcatgcccttggcaatgtagctttcggcatcgccctgcatagcattacccgtgactgcgataatcggcatttgtaggcccatgtcgcggatatgcccggtggcgacaaggccgtccatgatgggcatggagacatccatcaaaacgacgttgtacgataacggcttcttctttatcttggaaagtgcctcagcaccattccaggccccatccactcgcgtgaagccgatgctgcgaagaagtttcagcatcatggtatggttgaccatgttgtcctcaaccaacaagacatgtttgtggggtgcaatggcccgcattttatcgcagagatcatcacccacgggtgttaatacaggactgcggggctttagcgacgtagtaatggatcgttctcctaatttggcagtaaaccagaagacactgcctcggccttcgggatttggcgaatatcccacttctccgtccatgagttcggccaggcttttgcaaatggaaaggcctaatccagtcccctggtattgtcgagtgctcgagttggcaaagcgtgtgaacggggtgaatagggtattcaatgcattgtcaggaacgccaatgccggtgtctgtgacctctgtacgcactaggcaacagccctcctcttgttcatccggagaacacactgtggagacccgaatatgaccgctctcggtaaacttgacggcattgccgactaaattctgcaagatctggcgatatcgtaggggatcccctcgaagatttctgggaaagtcaggtgcaatgtccgtagtcagttccacgccgctcttcaatgaggggcgacaatttcgtatgaccgctccgaccacatcgttgacatccacgacgtcagaatgtagcgagaaagagccagatgatagtttcgagtagtcgagaacgtcgttcacagtctcaagtaagagtgacatagagtcttggatgattgcggcatgttcacgctgtgtcgcagacaaacctgtgtcggccagcatagtcatggcaattttcatcccattcatcggagttcgaatttcatggctaatgttagcgagaaagtctgttttgaggcgtgatgactcttcgaaagcagcaattatgcgcgcctctgcttctttgcgctcgctgagatctcgggtcactttgacaaaaccaacatgctgtccaaactggtagatgggggtgataagtacgttggcccaaaaccgcgagccatcgcgccgatacctccacccctcatcctccatacggccttctcgcaagcacacagcaagacctcttagaggttttcctgccaggcgatcctccgggctgtaaaagacagagaaatgtctgccaaggatctcctctgctggccatcccttcataatggcagcgcccgggttccaggtggtgatattgccctgtgtatccagcatgaaaatggcgtactctttgacagtatccacgaggatcttgtaggtttcgtttgtataggcatggttaatgctggcggtctccaccgatagcttgtgcgcctccaacacaatgtaaagcagggtaaagtcgttgtaaatcggagtaactcggaggttgtacaaagatttatcgctagacacaattctctcgactacctggatttccttcgtcgagcaggctgcacgcaatgcgccacagaggatagcgatattaggggcgggtacggcagtagggtcgagatcacgaacggtcgcatgcagcatggactggcgcgtcttgccggataaagcgagatgactatcagagacctcgacgatggtcatagatgaatcgaggacgatagtgggaatcggagtatggcgatagatgcatgccagagagggagacaccgctggggagtcatcgtcgggcacacgtacactgtgtgttgtcgcggacttctcctcgagggaaagagcggccaaatggccgtcgaggaacattgcggctcgtttggatagacatgagaaagggagaagaacggaagctagtcatattttttgtccctcttcatcgcgtggcggaaaagtcactgtgagtggctgaaacgcagccggcagcagaaccactcatgacgcttcgactgcgctgccatttgattggtgcaacttaacttggaagcagcttccgattcacactccaggcgatcgcccctgacatccccgcctccacccatggagttaagttgtctaggccatccgagagcagctgatgagtagtctaacttgtgttcgcttagagcgagaaaagtccgttcttggttgacgggtggcaaacgactgactatgtacctcctccgtattcatgcatatctgcttcatcgtgcggggacaaggaaagcatggcagttgtgttgagtctttcaaaacgagtcgacgagggtgtgggttagaactagctgctacttttgaggcgtttgagctgtctgaattgtttgacaactgccggtggccccattgggcccagccatcggagcaccaagccaccaatcatagcgccgtcggtagctatatcttgcttgctagaatggttaccatggagcggagcaggtttggctacccgctaaacctaagctgctaggttttcatcgccgaaaagagtaggaccacaagcctgggacgaccgggaatcccggtcggataatctcggctacattaagcccgcccaaatatcgcgacacttccgtaacattagacgaagctacttattctatgcaggaaagcaaaatggcactctcgaccataggccacagtagtctggtccctctatacccttcatgttgcggaatggggaatgagtccgctcttaagccatgcattgctcgattgagaccgtgttcatcggcttggagcgccagagttcaactcgagaaaaaaatatactgtttcgacatcacatgccacatggaccaagtttcttctgttgtctattaagccacattggcatgattgttgtatttgatgcccgacgcacgtcgactgaggacttactgtcactgtggctgctatcgattggggaatcatatgcgtactactagacaacatctatactagtatcctcgcgcccgcactttgtccgttgtactcccagttatgaagcgtacttaattaaggaatgcggggagataaataaagttcggacattaacagatcatactaacatccgggggacttgcccaattggtcatgtaccacggcatacacatgctgtccttgggcgaaagtatggggttataagtcagttttagtgtcagtacgaccatctgcacgggcgcgctttctataagcgtgtcagaagcttaattatgtgaacctagaactatattattgtccactctctccatatcaacggtcagtgggtagaagctgctccaggaaagcgctccaacgtaacaggtacatgaaatcccaaatgtaactacaagcattttatccagttgttaaccaaatgatgcgttgttgtcaccagatccagagaatcggggggttgtcggattataccccgtagccagccgctattgatgctgagcaagcaattcagtttgcagctgcagcgctggcgctcctggaccggtcgtaaccgtagtcggatccttcgtctatggtatgaattggctgttgaaaacaaagaacattttaacccgtctcctcactctggagaacgacaaggttaagccggctgccactggggaggtgctctttgcagcaagtttcttcgactagtctgctggagaagcaacccgaatttacggagatgctatcccatacagctagcccggtttcggattcctgttccgaaagagccaattggtgtctctgggctaagctacctcttatcttgtgtactattgggcaagaagggattatccatactatgagaacatgcagtgcgagtgagccgttgtgtatcatggattgatatttttcctaatataaataaccttcgtgtacatgatatagacccattcgcctcaaaacacgctgcaaaatcccataaagaaatcccaataacaagtcaccggcatctcaaggtaaactgtctatccgctaattctgtgactgaaactgatgaacaatggtagcagccgcgccttcaaaagtgataccccccaaaatcataaaaacaggcacatcaacgctaaatgtcttgccaatccagttacgcacctcaatggcagacagcgagtcgagaccatacgaatgcatgggtcgatgtaaatccagttggccttctggcacgcccaacagcgccgtgatacgggcagcgagtgcttcgctgacaagctcagtgcgctcattgactgacgtggcggccgccaatttagcaacaacatccttggcttgcctcccaggccttggaccgtgcacattgtccacatccccagcctcgccagccggcaatggaatatgatgcatgtgctgccagaacggctggctcaacacaaacgagacttcttcaaggtggccccagtgagatggtggacgaatgccgacaatgggatggcaggtgcttgggtgcgtggccaatttgttggatggatcacagaagatttcgagtagagccacaatgtcgcggatatacgtaggcgtgtatttagccgtttcgtggatttgtcgtcgtccggttgcgtactcggcattggtgactaggtagcctgcgtcgggtacagcgccgaggttgaaggagatggctcgctggccttgggacactcgatagcgcgccagagcatcttggtaagtgtttccggcattatatggtgctagagagccggtacccaaagtgcccatgacggatgatagcatgatgaagaaatccatattcgatggaagcatggcgtgtaggttccaggatccttgtacctttggctgcaaggtacccttccaactagagagtgatagttcggagaatatgccctcctaataaccttgtcagtaatttcccttagcgtacagtggttcattgatcgatcttacctccatgaccatggcggcttgaatacatcccttgactggtggcatagttgttgagtacttgtcgagtagcgctcgcaatgcactgggattcgtgacgtcgcacgctggcatttcacatcggacaccgcgatcttggaattccaatgccaaagactgcgcctcgtgtgtcttgggaccggatcttgatagaagaacaagatattgagcgccattattagccagccatcttgctatggatcggccgacgcctccaagacctcctgagataatgtacgtcgcattcgagtcaatatagtctatcttcttgcgcatagagcgaacctgaaagagctattagtatatgtatattctaacatgcaaggtatgcgtgaaatgagtctgtactcacgttgaccgtatccgattctgtcagttgcactacagcagcatccgagctggtagactgcttcaaaaacgccattatttcgtccagtcgcgagattggaaacatagggacctggcctcgtgaatctagaagcaactgcaagatgggtgtagaaacagcatattccagagactcttgcgacacctgaagctcgtcgctagccatgaaagacacgtgaagagaagacgagccaaagcgaaatgctgactgggatgcgtcatcggaaacgagcaccactcgcccattcttttgcatcatgcctctgaaagtctgctctcccagtccctttgcgactgaggtggtggcgaagacaatatcaaatttgggctgaaggtctgaccatgtcgaagaaaaggcggtgcccatagcagatgtcggtatgatgtatttttcggggatattgaattttttagaagcccgctgacaatcttcaatgctgtctgctgtcaaccatatctccgcaacaccctcatttaaaagcaagcctactgcggcttctcctaaaacgctgcaaccatccatgaccaaaacacaatcgcggtttcgtacccgacctatatccgacagagcatgatgagctgtcaagacagaaggaatagcccagcacgcgtcttcaaaggataaataatctggtagcttaacagcggatgagggctgaacggcagcaacggagcggaaacagttcttgtgtacagcaaaaactctatccccttgtgcaaaagaggatccaggtagtgtttctgttacgattccactgcagaagttgccaagctgagtgccctttggagccaaacctcgggcggctaattggtcttgatattgaagcgagatagctctgacgttaattggcaacgcatcttcaataattggagccggtacctcgaccaggtagggaatgccgttattgtcttcagggcaagccgctgatagctcaaagcttgcatcgatggcattggcagaggtcatttgccagggcaaaatgttggattccatattggctttcaggtatctcgcctcgacaagacggcgagtatgtaagcagccatctacctcaatgtactcttgttcgtattcctgagatggcttccgagacagcatctcccgtacaatctgcttgagatgatggatgtggcctgaggtgccattgcgattcatatcgagggcaacagagaccagatgtagactatagttctcggctcgcaatgttcttgaaagaccatcaattagcccatattctggtgctgccgacgctcctcctcctgcggagacccatagcatgccaggacatgcctgagcaaggactttcaaaaccgcccaatcctgctcagtcattgagctgagaaatggtgcaccgtagtcaaccaaagcaatgcaaagacggtttgagctgacggcgagactcgtcgatggtgcaagcatgttcgcgtccacgatttcaaggggctcagtaaacatgtcttgtaaggatgtaaccagagacgcggcaagagattgctgttgagggaaattgttcagcttgacgatggtaccgctatgatacgttggtgatgcaagacttcgcggaacggacgaaggcacgtccacagcggtagaaatgacacaaccaagctgatgagctggaccgtcaaaatccttgaataccatgtcgacacctgaaaaaccacagctttgcagaatcctgccccagccttccgcgctccacagcggtgacagcggacggtcagcttctggtccaacccaccatccagggaaaagaccaaaaataaacccaagcgcccaaccatcaggctgaagaaactctgtcagaatcaacttgccaccagtcttcattgactttctgacgttacggaacgtattttctagatctgcggtaatgtgaagcacggcgtttgccacgacaacatcatacgtcccgtcagaaactccctgttcggagaagtccttctcgatgtcaagggtttggaaagacatttgagattgatgatcggagaactcatctcgcgccttttccaaaaatgtcgctgacacgtctgtgaagcagtactgttcgcatcgaagggacccaggtgagttggatgattctgtcacgccagaagggccattcatagaaagtgcgttgatcagatggcgagttgcagctgcagtgcctccacccacttccaagaatttcatgccgccgttctggtgggcgagcagatcgacaaacgttattacttgcttcatgcatctgtaggtcatcaactcgtcgtagtactctccgagaagccctgtctgcatgagacggtctagaggcgttacactacccctgaagaactcaccgagatgcaaagtcacttcggtgtagagacgtcccaccctgttcgcagacttaactcgatcacagaccgtgtcaatgctctcagtgagcgcaggcgatgcaccgaggcgaccctctgtaacatggtaatttgcccaatgcaagtagcgccgcttccagtcacccttaccagagtctgccgtaatgactctaggatcaacagatgctagaagcgtatgtacagagtggttgataagtaaggtcacgtcttcgtaaaatgccgtcagatctccagtttctgggtgaatcttgtgcagatactcggaaagctgacagttgtcaagcttgtctatagccggcttttgctcaacattcatacagaactgcttcgggtcggccacaaaagcgagcgaagaaggtgttgacgtaatgttggccagttcaaagtcttgaaaccatactcgtagatcgttggctgcgtcaacagacaccgagcctcccgcaaccgtaaatccacggccagtcactgatgtaactcttgacaggcaagttagacggtcggtctccagagagctcagccctgatgcagacaaccagagacaaccaatgcgcgacggcacgctggttgccatggatgaacgaccgcccgacgtcaaagctgtgaaggcaagatgcaaaattgcgtcaagagatgcgggatgaacaacatgcccttgattaggcgagttgtacaggctagtcgtggccgtagcatgcttcagagtagagtgaatacgctgttcatcgcatcgggcgaagataggaccatactcatatccggtttctttgagatattcgtacatttgcttggctgaaatctgctggctgcatgcgctggcgttgtcgagaagagtcttggccatgttcttctgctgtcgcgcttcatgatcagatagccatccctcttccttccctcgatggtggatggtgatgtgcccttgacagttttcagaccagtcgtcattgccaaaagtgcgaataataaatgaaaatttggatgctgaagaacggtcttgtggtagctcctcgcgaagagaaacttgagcctctggtccgtcgttggaggccgtgaagtttattggggtcttgaaatgaacatcttcaaaagtgaatgcattcacggcatacccttcttcctcacacagttccttacctgcttctatggccatgacaagcattcctgttgcaggatacaacgtcataccattaacgatatgatgttcaacccaaggcatatccgacaagtccattttccagttccaacgagcatctgagcgattccaatcatttgatctggttccatggaaatcagatggtcgcttagatctctgcttgtagctgcgacttaggcgactatcgtgccagtatcgctgtgaatggtcaaaaggatactctggaagagttgtcaacatacttcgagtcatcacgctgcctgacggctcgttgatggctctgaattcgagattcactccttcgcagtgcaactggccgagggtgctcagaagtgtgtccacggcgcttttttttctgaaaagtacggcattgtatccaagctgtccgcgagggctggtctccaggatgtcgcgtagcgaggacttcaaggtagcatggggaccgatttcgagaagtccgtctactgctgggaccaacagatgactttggtccagcttcttcgtcacatctttggcaccttggcggcacatgaccgacacagcttgagagaactgcactggcgataccatgttggatgcccagtatgacgcttctgcgacggaagcgtcgctaacgactttgccagtcacgctggataccatgggaatttcagatgagaacggcaccatgtcgttggcatccgcataggcattgatcatggacacataatcaactgcaatgctatccatatgtctcgaatgataagcaactttgacgcgaagcttgcgggcgaagatcttctgttcctccagaacaccctgaagatagtcaatggcagcatcgtctccggaaagagtaatgctttgggggctgtttatacaagcaacggagacgcttgaagcgacgtggccatgggcagagagtagctcttttccagaggcctcagataatcccacggccatcatagcaccagagacgcgctccccggaatcggccaaatggccatcacgatccagtttggccgaacacacccctctaaagtacgccaatctccaggctaactctagtgaaatgtggccgctggcgtatgctgcagcaatctcaccggacgagtgtccaacaacagcagcgggcctgaccccaaatcgccgaagcaagttgactaaagcaacttgcaaaatagtgcacaacgactgactgagctccggattgtcaatgtcattggacgggtctgggtacacgatgtggttaacaacagaccaggcgcatcctaggcttcgcagatatgcgtcagcctgcaccaactctgttctgaaactcccgtagcaagctaactctcggcccatgccctgccactgtgctccttgtccgctgaagacaaagccgattcgtggtggcgactttgcctgcgcagaaaccggtgttgacatgagcgaggagatgttttcgaaatcttcaatcgtgttcatcaaagcaaatgacctccattgtagatgacttcgatgtgtatctaatgtgtaggcaaggttggccatcagatttgtaatatcattcgtagcatcgatagactctttcccaccctgctgccgtagttgctggtatttctgtaacagttgcttgataggagaatatccagtactgtactgcttaatgattctgccaataccgtccttgtctgatgcagaccacacaaagagtctttgtacgttttcttgtcgtggcggcgtcagtgcaggactcaatggcatcttgtcggactgttcccgaagttgaggtgggcgcttcgccgtattatgtttgccgttgaggccacgaatccgaagataattataggcgtcgtcaataacgacatgcgcattggcacctccgtatccaaacgaattgacagaggctctgcggagaccatttgctggccaaggacgtgccttttgtggaaactgagagaaaaggacttacgtgagccagcagtacatttgcaaagatggcaacttctagagcaagacttacggaaatattcagaaactcaacgtcaattttgggattgactttctgaaagttggcattgggagggataatccccttttccaagacgagaacagccttgatcaagccagccagtccactggcgccttccaaatgaccaacattcgacttgatggcaccgctagataatttgtcagtcaacgatgttacagaggatgtagtgatgggcagaggtgcttacacataaatagggtcgtcgttggagcgatgccgcatgaaagccatgccaattgcttgagcctcgcgagggtctccagcaggcgttccagttccatgagcctcgaagaatcttgtgtgctccattgaaagacgagcctgctcatatgttctcttgatgagctcttcttgagccttgcggtttggttgtgtaatgccaggagtgcgaccgtcttcattgcaagctgtcgcgcggatgacagcgcggatcgtgttaccgtctctaacagcatctgatactcgcttgagaacagtgacagcgagaccctcgcctctagcatatccatttgctctctcatcgaaggaatagcagcagctgtctggtgacaagaacttgacattggacatccaaacgtagggctcaggcgcactcgccatattggagccagcaaccaatgcctgcggccaattagtcatgatttcatggaacgatgaggcatgaagtcttagacgcaccatggagcaattgccgtttctcagtgcggcgcaggctgtgtccaaggccatggcggaactagaacatgcagaatcgacggccatgctaggcccgcgaaagttgaagaaccagctgattctattggcaagcatgctgagaccaaatcctagtgctgcatagggaggaggaacctcggcgctgcgaacaagttgcaacatgtagtccattccaaaagagccgcagtaaacggctgtcggcgagccgttgacatgttccatcgggataccagctgtgaatgtatacgtaagcggtctcatcgttgcactggtgggatctgaggctttcttaccattttccagcgcgtggtaggaggcttctagtaacagtctttgcatgggatccatagacgctgcctcagtaggcgcaatcgagaagaagccggcatcgaattcggcaagatcgcctttgataaaatgaccgccttttaggggcatctacaacagttagtgccactgtgcaaatgcgcattgttaggattcgagtcagggtaaaactttacagtgtttggccgcgatcgttgatcgtagaaaccatcgacattgacacgatcagctggaaactcggtcattgcacagcgtcgttgcagcatcatatcccatagggcttctggagtagttgcatcttgtggaaacttcaacgagaagccacaaatagcgatgtcattgctgtcaatgccgtccagctccggcaaggtagtagtagggtcctccattttgcccaacgattatgaaatattacgagcgcggcggctctgaaaatatatgtacagaagaagaaagaaaatagcaatggaaatatgaatcgcctcagtcggcgatatcccgcggttgtaccccaagtctgtagcccgcaggcagggcacaactaatatacgccaggtgccaaacgaaagcggtggatagtgaccgcatgggctaaagtagaaggttggcagcaaggtgaaatggaagaggcgcggagattgacaaaggtaatacagatagtgcaaaagctcattaacataacatctgtgcaagtagctaaatacattgggagcctccataatacgtcgttggctgtcagcccaaggcgtccatgtcaggacgaggcgcggccaatcgcacgtcgcatcatatgaacggcctcggtcagcttggattgtcgaggaaactcgtgaccaccttcatgaacggacacaaaggtttgcgacggatcgcataagctagccatattagccccaccggtcggagcaatcaaatcattctggccccagatatgcgcagtgggcagtttaagacaccctggggtgggagcaaggctgagctgagcgagttcggcgccgctggaggcagtggaaaagaagacggcaaagcggaacggcagcggtttcccttgttgccaaagctgtaagaggtacagaccaaccagaacggcccccgccgagaatgccaccacaccgtcgaagggcccctggtcgtcgacgtagctgcttaactggtccagggccacaaggagcgtggcggggtcatctggattgtagaatgcgtagaaagcttgatcggcaggcgttgccaggctttctattcctgtatagcagttagcgaagcagttaatatctctttttcattatgagccgtaccttcagccatgggagcctgcagagtgccttcgacaaactcaaattcatggtcatcttctagctcgtggatgagtggggctgtggtgggtgctagtttagcgtactggaattgcccagaagaacggggggtcgagagtcaaccttaccggtctgcagcttcattatctgtgacgcaacgtagtgttagaccggatctgtttctgcttattcgtaaagggctaggcctgcggaacgcaagttggcccgcccacaatccagaggaacaataaagaactaacttacagcactgttggtgccattaccatgaaggcaaatgatccgcattgcgcgggtttcggtgatgcaagtggacgtaagttagtcttgagagttgggagaccgacgccacgctttagtgccaagtgtcacttggaaaggcaattattgtgcagcaaggtatagcattttataaacgatcatacgcaacatatattgcggtttagctcggtgcttttatcaacacatccactctgcacgctaacgtatttcacgagtgagtgtgacacttccgttagcgcgccttatatgtaactgaaaattcaagtatatgaatgagacctataaatcggaagatatatgttctctagatttaatagcacctatagtgagactatacgtacaatcctcattacgatatttttattacattcagagatatactagagttagatgtcctgatctacttaataagtcgtccttctataggaatgtaattttctgattgatacaggctcttatacttagccagcgggcaggacttggtaaaaggtgtcagactcgcttgtgaaactagtagttacgttaagttgccttaggctgatataactagttaacaagtagttagttaactacgtgccgcgtcgttgaaacatcaggtagtagaacgttctccgggccaagaagtccttacacatcaatataaacttaattatcttcctagacaagctagcagggatattgatcctagcgtttcaggcggcacgtactaacaaaacaccacggggaaccgtagtattattagtacagtaatacatcgctatcatgggcggatcaacaaggctggccagcggcatgattggccccgtgcgtccgtgtctttgctgatccttttgggggccggaccgtaagcctgcagacaaacacagcctttcagggtatcccgccccctccttgtcatcagaatgttgctgtgttcattcaccagcaatgcaggaatgcaactagcctccgctcactcttaccctacgaaaattagtagcgtctccaaggctcttttttgaggggaacaaccatgaccacctgcccgccgctggcgggttgtctgcctctcaaccccacctatctcaatgagggcaaatctcacattgaaccgctgcctaagggttgaaggtcataggtggccaacaccccaaatttgactcactattaagcgaatattggtcgcctaaagtacctcgttacggtttctacctgtactgtctacacatgtcgcaacaacccgctatcttaccgcgctctgcggcgcacgataacagtcccggaagtatcaggggtttcttcattttcatcactatcattactatcctctctatttcgcttcgtttctggtcacgatgcatccgcagcaacgcaggactcggtgctgggagacatactcagcgtctgtggtgggatgattgggccgctttagcagccgtggtaagtgactttgtgatggatcttccaaaagcccaaaagcccaaaggggtgagatgaagaagaagagctaaacaataaatactacgagctatgcaaaatgctaacttcatttccatggcagccctggatcctcggcctctgcggagtggcatttgctatgggcttctatggcctcggccaccacgctcagtttgtcgattcaaaggatctagccatcttccttagactgttgtatgcagtatactacgtctacgatatcggcctctttttcaccaagctctctgccattctgtttctctcgcgcatctttccctggcacgcaaactccaagtggttcaactacaccattgtggctacccactgcctcaactgtgcatggttggtcggaatcatttttggtaccacatttatgtgcaatcccgtgcagaagggctggaatcccacattacctgggcactgcggtaccaccagcgccctttggcttggaagcgcaatacccagcgtcatcattgacctcatcatcctgctgctgcccgtgccaaagatctggtccctgcaaatgaccaccacgcgcaaactgggcatcattggagtcttcgttattggttacaggtaaagtgttggactgtggcaataattatcgcgtcatgacactaactaagaacaaacaaacagtgtcattgtcgtttcccttggccgactcactacagttctgctgactggtagttccttgaactcggatattacctgtacgtcagaagtctccgatacccaatactcctgtcctgtacctaatatgttcattctttatagacacggttgttcatctggcctactgggttggtgccgaggcgcccatcactatgctgtgtatttgcctgccgcccatgactactctgggccggtatctagccaacaactacttttccaagatatccagcagagttcagtctctgtttagcaccattaagggcagcagaggcactgtggcatcacggagttactccgcaccggattcgcaatcccaaagtattgcgatgcacaggagctccatgaaaaagagcgttgacaatgacggccacagcctagagtcacaggagagctctgcgcatttattcccccacgaagacgccaattactatgctggcgctagagccaatgtttcttaccctcgctcgggtactcatggtacaagcccgcttccgaactctggcgacactggcattcgtgtagacagcatcgtgactgtcacgcaacgtgtgaggaaataattgactttggagactgtactcgttgtccttatgtaaatgtataatattttcgttaccttctcatttcttcctccgtatgaccgtaatcgcattgatctcttgatggcttaggagtttatatataatggtgtcaaaatcttgttataccactgcgcccagcttgaacctgccttgcactgtatgctaagttacattgaagtcctctcatggattctacatcttaaggatgtttatcagataataatgtcttcaaataccgtcttcattcaattaaactaccattactattcgtccttgctgatccatcgcttggtgtcgccattgatctgatctagcagcgaaacccatctataaccagcaaccgtgtgtgcaatgccaacaagttcagactttcccataactgacacagcttctttccacgtagcgtcatcgagtggcgtcttaaggtcggttaaaatgcgaccgaggcgatacgccatggcctcttcggcggacagatccgcggggacttttccggccaaggcgtcctcaaactgctcatgagaaaggccgcatttcgagccgatcttgcgatgacagtagtcgacatagggcacatccagcaccgaggagaggccaaggatagccagctctctattgcgaggcttgacggttccgggcgcatacagtgtctttgccatttcgaagaattggccgacgaaggccggattgtagctgtattgaacggttagcttcggtgaattttaatttaaggaatgtgtgtattagtttgctcagcgccagcccaggcaacttggcaaatagggcttagcgagcgcgagctctcgtgccgcaatgatttcctatcagtggaaagcaggctgccatacctcagcgatgcgtaacatccaagtaaagagctgccgtcttcttcaacccactggaaagggatgtcattttgatgcatcactgtcaacgcatcctggatggtttgtttggaagcagcgtgctccttctcgtcgtagggaaagcgatgggtcatggtgaatgcgcggtgatcctgtctctgtctctttggtttgtgatgtataaaggtcaactgtaccaaggaaaaagacggatgtctatacactgcgcaaggcttacacctgttggtttcgcaaagcctacctcggctgactgactagatgtgctgcggaatgtgtactgctgcctggctaactgctactctgtttcttgggggacaaatgcaccggtagcggttagtttgggggcgagaatagatgagtatgatcattctttgcgatatacctagccaaggatctcagaggctctgaggtgatcttggggcgcctaatccctcgattgcacgctgtcaaccttgtaacgaactacattagtctccttcctgttcaggtaaagatgttcacatctccaccggttttgtatgtgaaaaataacatcagaattccttaaccaacttgctatattagacctctagtaggtatatactctactaccagtgagacagagacacacgcaaccatctaattatttgaaataacagcttttcgtcttgcctttgactgcataaataatgtgtaaattcaattcccttaaaaagatgggaaagcatatgataatagtaggattatatagagaataatattttcatgcttctaatagtccatcgccctgatctttacatattgaataggcacgcgagacacgctgacatagcaggtagaagagacagataggaggctaatctaaaaagttatctaaatctttactatacaaaacaagcggggtggtatattaccgctattttagcgtctgggctcaatctagcatttcccacggttgacagggtgcaatcgaggggttggatcaggcggatcttggggggcggaccctgacccgtgacgggccaattggccgagagtgtaaaagtacccgtggagttgtagtgattgtcaactgtcaaaagaaaaaccaaagaaccaaaaagcaaaataaagcaatatagtaggagtacggaatatttcaaaccggaggatcaattaactcatggcatctcttgaatagatacaatacttctatcttactatactttcgccttgtctgtgctcgagatcagtatcaatcacttccacctatctaatattaagactgactcaattcttatcatcagctcatttacaaagtacgtattcatgcatccacccttgcatgcccgcaggcaatcaattttaagcgagcccgctgaggggagtgagaggctcggcatatcaatccgtccacagtccaaacatgatgactccggcaaacctccgagaagtctgcaggggtcgagaggctggcatgattggtggggggccttaacagtgtatgagaagctgaaatcacccctcaccagccatatgcctacggtgtatgtcggacacctgatgactctcagtagaactagtataccgaccgtaatcccccagcaggctgacgtggcacgggccgcacgaggggccaaccactgatttcggcgagcggtttgcgaagccgtaataccatacttacctctttcctactctgccccgtggagaatatcacttcccttttcgatatactactatcagcgcggtaagtactagtctatgtggagtataagccgaaaggtctaatatagcgttatactaagttacctaatactcactagctggacgagccagccatcgtcgggtagtttactactccacttgaagctggctgtgctctaggcatgaatcgaagagttgacgctattagacaatgcgttaatatcatttcacatgcagtggggtctgtacaaaaacaatttgggtctgcctgcagtcatgtcagcccggagcctcgttgttgcaaggcagatttagcaagctatccgttcatcagctgctcaaacttgcgccgcattctcagtaactcgccaagctccctgcaagctcagaatcagctctgaacactgtctccccaagtataccctgcatattagtagaacaccatccatgtaaattgacactaggaataatctcatgtcagtaacgaggattaataacctatcatagatttcaccacaaaatgacatcgtcacaaccgcctttgaacattgttgtagtaagctttacctacgcttccagttacacggaaccaaggcatcgttgacaactcatgtttcgcagatcggaggctctctggcgggactaatgaccgccgtggcactgaagcgaaacgggcataatgtgacagtcattgaaaaggaagacaatgaacgcgaaagccacatggctggcgtttgtctaggactcgatgctgtggaattcctcgagaaatacgatcgcgttcagagcatcttctctcaccagtcgcgtcgtattcaggcccttgtgggcgacgacaagctgaagacctttgtcaatggccgtcgagaaatcacaaactgggataccatgtactaccggcttcgttgtaactttggtggctatgcaagcgatacctaccctacatcccctttgccctctccagaagatggccagggtgtgtatcttgctcaaacggaggttctcgatattcaacgtgaaatacaacctgacgacgacgatgacagcgacgagaagaagacgacaatgagcctcacgttgctggaccgcaaatcaggagacaaggccactatgcaggccgacctggtgattggtgcagacggcccggattcttttgtgcggaagaagtaccaaggccacgttgagcggaaatacgttggctacattgcttggaggggcactgtcccggagagtgaggtgtcggaagaaacccgtcacctcttcagacgcagcgtcactgtgtatatgatggacaaacagcactgcatcgtgtacaccatccccggcaagaacggatcgctggagcccggcgaaaggtatctcaacttcctctggtacacaaacgagacgaaggaatccttggacgaaatcttaaaggacggcctcgacggccatcgccatcacaacattgtcccgtccggtcgtgtgcgacaagatatctgggctgaacgaacaaggcaagccaaggccctgccactcagcaagccaatgctggagatctttctgaagatccagcgtccttttattcaggtcattaccgacttctgctcacatcaggcagcctttgaagatggcaaggtcctgctggttggcgacggactgtcgctgttccgtccgcacacagccttcagcggcacccaggcggcgtttcatgccctccgcacggctgagttcgtcaatggcaagacaaccctgcaacagtgggagagcaaggtccttaggtactcgcggctgcactacctgcagagcaactggtatggagacttttatcaataccccatgtcgtcggccctcgtggctgctgtgcgctactggattatgtgcggcgttgatcgcgtcttgtcctggtacaacggcgaagctccgctcttgcgcacaagcacattcaagagtgaagcgtacgacgacgaataaattaggccgaggaatagcctcattctattagggaggtgtcgttccaccccatactggacgtctacagtaactaggaggtcaagtaggtgggatgagtatctcaacggaaattgtgaagttgacacaggcatcggttactaggaaaatggacattgacataatagccaataacctcatgtttagttagctttgtatataaccatatattaatcagcaatactttctacaattcaagtttcggacctgtataaatgatttggatttttgacatttatatttccctttttgccatttatttttatcattctaattatctttctctctgttattgacctgttgacctgttgacatgttcaatctctcttacatcatctgatctgaagcaagcagggagttatgcacagtgttggaccacgcggtgcgagtgagccgctcaggctgtttgaaccttgcagtcgcgcaatgatgcccgattttggcgaggtgtctcgttacctccaggcaagcggctgtaattaaaccgagccactactacccatgctagcgtctttattgggaatgtggtcctttgtcttgtctgggtccttcctgtaagcactaaccgtaacgctggcggttgaggagggggcgcggcaaggctggggccagaacaaccgggtgtgctcagtgctcagtgactacaattggggctgcgggcgcacccgactagtgcaagggggtggggcacatcaaggctgtgatcaagagcgccatccagtcgttaattaacctgtggctgtccattctttgtatgttgtgatcggcggtgacacaggaaaactccttgattccccgtgcctgtcagcggaccgatgtggcacaacaaggctatgttgatgataaaaagcgctatccactgactcgctaggcagttactgtccattactctatgttgtgatctacatttacccgggagaaactttttggattccccgtgcaagcctgtcagcacggctggtcaaatccagcccactcttccttccaggcttaaatccttccgatgcgactacagacggatcagttggccaggaacgtacctgcatcatgccgccgacacagacaactgcttcgtctacaagcgacaatgttgaaaagtctctacaggatgccaccgtcagtgacccgtcggggtctgctgatgctgtgaccgggcgcaagatcacgggtgttgcgtggtttgttgtcaacgttgccctgttatcggcgacttttctgtatgccctcgacaataccgtgacagcaacggtgcggcctgccattgtcgacacatttggcaaccgcatagacatgctaccatgggtttcagtggcatatcccatgggtgaagttggcacaaatcccatctggtaagataatcaagcagcagagcgcacttggcgaatcgactactaacatttctgtttacagggcaaagctcaacaagttcctcaatggcaaatttgtctttctcgccgccctgcttatcttcgaggtaggatctgcggttattggctcagcgtcgtccattggcgctgtcatcgcgggtcgcgctctggctggctccggcggctccggcatctatgtcggcaccattagcatgattactggaatgacgacagccaaagaacaaaaccagtatctcaacattgtcggaatggcatggagcctgggaaccattctcggccccattatcggatctgcgtttgctgattcgcctgcaacatggcgatgggctttttacatcaacatctgcattgccgccgttgccgcccccgcatgtatctggatcatgccttcggcgccccctagcgtgtctctggggatcatggacgtgatcaaggcatttgaccatctgggtgctgtgctgtttcttggctcggtcgtgtcgacagtcatgctgctgggctttggcggcgtcgtgtacagctgggatagtggccagatgattggactttacattgccactgctgtgctatggatcatgtttgctctgcagcagaaattccaccttctcacgtcagatcgtatcttccccgtgcagttcttcaaggatcccttggtggtcggcctgtggatctggacgattgtcgcaatttctgacattgtcgtgaccatctacacgctgccgctgtttttccagtttgtgctgcatgattcttcgatgcgctctgcagtctacacgctgccttttgtggcatccgttgtggtcagtgccggcatcagcgggggccttctggtcaagtttccgtggtacaaatgctggttcatctgggccagtgtgctgctccttatcagcaacggcctgctgtccagcatccacacgcacacatctagggctaccatttgtggctataccattatccagggcttcggcgtcggaccggtcattcagcttggctatactgtgggccagttgaagcgtccacaggcggcacgaaaggatgttaccgcgttcttctcttgtgcacagatgggtggtctagccttgtcactgggcatcgccacctctgttcttgttaaccatgccacggaggagatatcgcacattctaccaaacgttcctcttagcgaaatcagaggcgccattgatggagtgggaagtaacgtgttcgcgacgttgaccgaacaagttcgtgatcaggtcaccaacgcagttacgcagagcgtggcctctgtgttttacctgaatttgtttggtgcagggcttggcttcctcattgcccttcctctcaaattcgacaagctggatttcaccgcgctgcaataacacacttcctcgtctgctccaagctgacttggatctacgtcatactttagtgttagcatgatagaactgtaatcttctcagtccataataattgtcataagtctttgtatgtatcctagaaaagcattacagaaagtgcatcgtagcaagatgcgagttatagtaagatttggagtagcaaatggcacgcaagcgaggtagcatccatcccccaaaatagcgcacggcaagctagggaccatctcatccggcgtaacgcaatgttacccagaatgaacctagtcattagctgggggcgatgtatagcccgccccgcaaacctcgcggccatacctgagacactcgcctgttgctgaccgcaggtggtgggtaacaagccgggcagccttgtccaccaaaatgaagtggtgggcactaagaggcttacagggatccacgcgtcacagccatcccgcggggttgatgccagccgggcgaccggcctgaagctattaagcctagcgtgatcccatccactgcgcgcaattcaatcccatcaccatcccccgcaccatcacatccaacattccaacaacatgggcatttacactcggctccccgaaggcatcgacgaggtcgacatcatcatcgccggcggtttgttcatccacctctccccctcttcataagtttatcctaacgagctcttttcctctcttgttaggcggtaccgcggggtgcgtcgttgcgtccaggctcgccgatgccgacccctcgctgtccatcctcgtagtagagggcggacagaacaataagggcaaccacatgattgccttcccgctccttttcccaactgcactacttcccaccagtaccgcaaccctgttttacaagggaaatgcggagccccagttggacaaccgcgaaatgatcgtcccaaccggtggtgttctgggcggcggttcgtcaattaacttgatgatgtacagtcgtgctcaacgccacgattgggattcgtgggccactccgggatggtccacggatgaaatgattccttacttgaagaaggtaggtgattggatttgcgagtatgtactacagtgttgactaacccgccatgaccttgttgtagcttgagacatatcaaggccctggcccggattctgttcatggaaaagatggccctattgttgtgtctaagggaacattctactctgagcgtgcggcagatcaattcattgctgccgccaacgaggtagggtacccgaccgtcaacgatcttcaagacctcgacactagcaacggcgttcaacgtgccctccgctttgtcgactcaaagggccgccgccaggatgctgccagtaactacttgcatccgaagctggaagatggagcacatccgaacctccacgtcctcgttgagaccaaggttatcaagatccttttcgagggcaaacgagcggtgggtgttgagttcaagccaaaccctgccttccaaaaggaagacaacaaggttcaacgcgtcaaggccaggaagctcgtaattggttcctgtggcgctctcggaaccccattgctcctcgagaggtccggtctcggcgacgaagccattctcaacaaggtgggcgttcctgttgtcgcccatctccctggaatcggccggaactaccaggatcatcatctcttgattcaaacataccacagtgccttggagccaaacgagacgtttgacgcccccctggccggtagaattaacatggaagaattaatcaagtcaaatgcaccaattatggggtggaatggccaagatgcctcctgcaagctgcgtcccactgaggccgatgtcactgccctgggacctgaattcgaggcggcatacgcaagagactacctccacactcccaacaagcccctggcgctaatggctttactgggcgggttccctggtgacccatccaccgttgagccaggacaatacctcgcgacctctttgttcaccgtctacccctacgccagaggccatgtccacatcacaagccccgaccccgacgcggatatcgcctttgaaactggattcttgaaaagtgacttggatgtcacaaaactcatctgggcgtacaagaagcagcgagaaatcgtccgcagaatggatgtataccgcggagagtttgttggcgcccatccaccgtttgccgaggattcggccgcggctcttgtcaggctggacaagccgaatgacaagaacatttcggacatccaatacactgcagaggacgacaaggtcattgagggctgggtgcgcaagaatgtcggcactacctggcattcactcggtacttgcaagatgggcgcgcaggctgatggtggcgtggttgatgcagacctcaatgttcatgggattgaaggcctgaagctcgtagatctgagcatcgtacctcaaaacattggcgcaaacgcagccaccactgcttatgcaattggtgagaaggcagctactattattatgaaagaccttgggcttcctgtcagccagtgagccgccgctcactttactagtgtaatggtcggatgtgtgcacagctgacatattctgttttgaattattgacgtagccgattatatgtattcatctttttttttcttctttaaagaaatgtgctatcttaccacgatattgtggtggggttatgtctgtatgtaagcttgacaatctacctaatctgctatagactctgttcagtgagtttgtagatatggacctgtgcgcagagtgttctgcccgcggtagtactttcctcgcacaattttctctctcaatagaaagttttgagtttgaaagtcgaacaagtaggcaacggctgcaagctacaccacattcacctctgatacgccctccgattagcattaatcaacgcaataccctccttacgccaagtatccggcgccgcatacgaagtgacattcgcatcccagatcatactcaagggattctccagatcatacacgggccaattctccgtcttcgtagcgttccttccgcgaccagtccacttattaggatccagactattagtgaagctgatccacgagccggacatgaggtagctaagctcagtatagctctctggagcattggtgaacgggttcggactgaacccataaccattaaggttgttgaagatgaagatcacgtccgagaaatgcgccacgccttcttccctgttgtaatcgtctgtcttggtgttgaatcggtagcaatatgctgtcaggttatgtgccgcccatagctcacaggtgtagcgcgtcgcggctatgaactgggcgtcgccgtagtatgctgccgtctggcggaatgcggcgccgtagggctgtgggaaggtgacgttgccgccgagttcttcggatgatgggatgccgaaggaggtggtgttggggtagaggtccaggagcgaggatactacctgtgagtcgagggcccagccgtaggttgttgttgctgggttggtgttattgggatggggatggggggataagggaggaagggaaggaggtacgtacagctgaggtattcttttaattcggcggtggtgttcactggttctgggcactctgttgttccttcgtccgtggtgtagccgattatgattggtactttgacgaagtctcctgtgtcgagttgctcgctgggatatcgcgctacgaagtcaccgtccactgtgggcctccagttgtaaggcgtcgtgtcgttggcggtggtgttcagaatgttgtttaggactgtgaagggcgtgcggcgtagacagtccagtttgcgggtggtctgggaacatcctgcctcgtctgctatttgctggaaccaaggctcatatgtccaggtgaggttcaaggcactgccaggtaacaccgcgccggactccatcatgcctccgcggaagagcccgtcatctcggccgttgtacgcgcggatttggtatcccacgctttcggagccggcactttgtccgtaaatcacgactttactagggtcgcctgtataggagtgactgtcattagtaattttggactgtgtacgtttaatagctttatggaaacccaccaccgaaacctgcaatgttctctttcacccaatgcagggccaagcgctggtccttcagcccgagatttaacgatccctcattggcgagctcgaccccattgaagaaaccccaaggaccgagacgataggcaacgctcactgcgataattggctggccgatattgaccgagtgttcaacaataaatgtaagattgtatcgaaggtcgggagtgccgccttgtgcgaagccaccgcctgttttgttcattcagcgtcgggagtaacttgtcgttgaggtagatttcactacataccatgaatccatacaaggactggaagactggcattgtcgtattcagcgggacggaccacgtttaggtagagacagtcctcgctctattttgctggttagtagagaacagcgtaaagaaagtggcgtcaaatcctcacctgcagataacctttttgatcactgccgtaacctatacattcctatcacacgcgctgttagtaagtacatggtcgtttagcagtctgttcaggctacttaccatcgcatagccggtagcagggcgcaatcccgaccaagactcattaagactctcggggttggcccaacgcaagtgtgccaacgggggcttagcaaatggaattccaagaaaataatcctcattatactgaggcatgtagacaccataataacttccgttctttgtctgggctactgggttggtgcaggttgccaggctggccatgcccagtgccaaccaactaagcgtcgggagcattcccttcatcgtgttcacggtcatgctatgtcttcctgatatcgagacataatgatagaaaagcgataacgaggcatgagtgatcacggtgttcttataccctatggctcagtcctccggccagcgcattgaggggtcaagtcgagtcgaatgtccacgacagccaatttgtttggtcctacattccacacatgtatccgtgttccattcctgcacccccgcatctccggatttaagttgtggggaccgggactgataaaggtctgtgttcgtgtagttgagagccatatggggccactgacatggtcagttcggacacccatactctttcgggaaggtcgcatcatgcaatggattcggcttatgtccgagcaagcatggatgcgctctcacgcctgctgatgtcagcgcggcctggctggatcgtaaatgtaaatgactcttcacggtgagatgaattgtgagatacgttaagctttcagtcattgattgagttatagttcacctctacggcaaatgttttattcccttagggctgatatagtcaacagtaggggtgaatgattgacggagaaaggctcaaaatggcttcatgattgacgagaagttaactgcgctttttcacagagatagtctgtaggatcataattgtctttagcagtattcactgagaaaaatcggagtttagtcctgattcagaagcatgcactgctaaaacagtgtgactagtggagtacagtgcttaaaattgcttggatcttatgcactgagcgcccgacatgaaaggctggttggagcgaagataaacctctttcaccgaatgtgaccgtccaacccagggaacgagatttgatcttgtagtttctatcggcaactcccacgtttgactgcagtatcgggaggtgccttgcgaggatgtgagcgatagtggcaaaccccatagccagtaaaatagaacaaaatggccggaattttcagtgataacaaaggtacattccgcctccagggaggtataaaacccgcccggatccctgactaggtgtaaaatgaatctcgggcagcaagctccacaaccgacaccaagcccccctggggctatccaaacctagggtccctaccaaattacgccgagcttattaaaggcaatgcagagtcgtgatgacaaataatactgttataaaattcactgaatgctggtacttcaccagatgtcttgccgtctctgccgcctacgcggccttatataaagctctcctcctcctgatctccctctcgcacttacctctgactttgcatcatggtgtttgaaaatcaccttttttgcgctcgcactaccatatcactcaatcaagcaggctcagaagtcccataacaggccattgaaatgccaaatacgaaagaggccggagagaaaggtgaggtgcgctcaagctcaacagcaagagtgctgttagtccctgttgtctgtactgaggctgcactactagaggagccgacttgataacagagatatatatttattacttgatggggtgatttgcctttgaccaagcgcagtgtacttcaagggtgcaaaataaacccttgcaaccgcaacagtcactgccaattctagcaactgttttcaaccctgctataacaagattttccttacgtgtgttttacacctgtatatgaacaagattcacgacgaaaatcacgccatgcagtattccggcctgcagcagcctagaggttgccactgcgaagccatttacagctcatctcccatctacacagcttctcaccatacagaaacgcatttaaccgtcatctgaaagattatacattcacggctatccttttctaccaagccgatatgtgcacgcgggactgctaggcctatcaggattcctggcagcgcatgggtcagtcgtgtctgtctggtgtgaccgagccgaacctaatagtttactggaaaccgggatagcatcgcaaatctgcaagataccgaattctctgggcctacatctggcaaatagggaccaattgtggacatcagaattgatcctacccttaatgagtccattcaagaaactcgctcaaacccggttggctaacatatctaccaaagtggagtgatggctttattatatatcttgcaggaatatccgtgaaatatgttgaggtctaattgttgggtgtacaacctttccatgtgagatgcgatgatgagttacaatcgtctcaatttcactgaagttgcatcatgacggaacagcacatcactgcaagcagttatgccctgtttgcgggcaatggcaagagaagtcaatacaccgtctcctcatttgcttttgcaacttcttctggcactcaatgggccgcacatagctggtgtggctaccagggttagttagatgaagcaggaagcgcaattacgtccggctactccctgggcataaggttcaaacacatatggtcactacaaagcaggtgcaccatctgttctgacgacgatatatgctgcacgtggagtactacagcaaacagggtctatggaaacggcgagaatatcaccttctgatcaatccaccgctagtcctaaggaaggtgccttctcgaatttgccttcgcaagttatcaggatcaaccagtccggtcaacacctcactgtctggattttccttggaggaatacagttcgcttggttgtctgatagactacctaccaagaagagtcgtaatttgggcgagtgtcctatactatagcggtacctcgaacactacagtatcaaactcgccgtcctcgacagtgacatcgcaaaacgcaatttggatacagtctcctaacagtatacagaacaggaaatgtgagcagcccatggctgccagtacgtaccaggagcactatgacatgaccatttacaggctcaatactcggccaattcatacgcatgacatgccgagtctgtcaggaacagatgtcacccccctcattagaaaaaaaacgcgaggcgtgtcttacggtaccagcagatgtacagcgatatccagcgtacactaatgcgccgtttattaattgagtgggcatgacatggatcattctgtccccgacgacgatcccgccagatagagtagggagtacactcggactgaaatgtcacgtggagggtgccaaggggggtgtacgtcccaaatgaggagtctctcaaggtcgactatcttaaccaactggcgatggctggttatacgttaatgggaagttacttgtcggtccgcagaacagctgagaaatttcgaatgtgccaaagtaatgcggcactgctggtcttccgggctcttgtggcacataaagtattcctatacctcttgtgattgtgtcagggacatcggccatatagtcgaagcaatgccgttgagagatttggtctcccgtgttcgatgcttcccaataatctgtcgcgcgctcagttgtggctccgatattgaataagcgggggcgcttctgggatgctggcttgtgcagccctattatgttcgtctacagaagattatggtagtgcagaagaaagacatttcctaaaaagccgttgtcgattccaatttcttcgaaagcaaagcttgtcttcctctggcaatacttgtcggaacacgatctcaccgtcaaatcagcgacaggaaagattcatggtctcagatatgtgcgtctcataggcgtatggaagattgggttagtatttcgttggtggggtgcagatatgaaaatctgttcaaaacaatactccccaaatccttggtgcttcactcagacatatttcttgtggttgccttctgctttgaacaagacaagacgcatcttctcgaggacatgtttatgtactccgttgatatgagtcggatcccatattggatgcatacattcaagaaatgtacaatgaactcatcggcatcctcacctctaccttcgcacataggtatcctacttcaaaggacatgcgccggtgctatcagtgcatcaagaagaagcagacgctttggcaagcgacatcgacgcgacacgtctgtgagatgtcatctatacctgtcacccatgttggcacggctctcatcgacttctactattgcccaaccttccggcgtatgagatcctgcaagcttggccgtgccattgggcacatagccagccgttgatcgagatatcaaacaagacctcgagcagcatcttgcctggtgtgattgtacatatgtatttgctctgcgggcaaatgagatgactctgtcttttatactctccccgaaagggctattgtctggactcgaaagatgagcggttccaagaaacagaaaggccttcacgtggcggcccatgtaaccagggctaatagccttgcgccattttcgccgcagcaagccccctatgctctagctaaggtttactcactaatggatctgatctcccttaagtgctaactcgttctcgcaataattaattttcgtcatgggcaaagcaaggccttggagaagatggatgaacaagagggagcgaacaaagggaaaggtacccagtctggcatgtccgccgtgatatgggtggctctaaagcgtctcgaaaatgtatgacaatgaacgaccaaaaagctgcttggattaagacgatacagaatccgaattaccagcctgtggcttcctcttctatggggaggactgctgtagacttcgcttctggtagtgatccgttacactccatgaacaatgtcaataataccagagatccgcatacacggacattctggtgatttggaggactttggcgtcgtgttttctggcacataaagcccgcatacggctgctggagttgcaggacaatgttcttgtcaaaggacattgtaatggaagaagatggccggtgcgagctgcgtagactggggtcagactatctggccatcagagagaggcagagtattactaccgatcgaggaagaagcctgctcgccgtttgatctattatattgttgatgccatgtatctgatgctgttttgagcatgaactggtgaacttgggttgtgaggaaattgggaaccaggatttgttctgggagccatggtgggcgcagaaattcctaatggtaatcagactgccgagtgcccatttgaaaataacgcaacatgtatcctgatcagcttattcatttagtgctcaatattaggcgtgcaatcgactacaagcttaatgccagattagatacgagcagccctagattcaagtgagtaggaactatcgaagactaccccgccttcgatccaggaagatctcttgttacggaggacaactacaatctgatgagccgttatggaagccatgtgatatttagagtacaggatccagactatgtcaacaaagaaacaaatgttataagcagaacttgtgttatatgaagccctgcgtagtactacaatagacgcccgagtgctgtacatgttgaggcttcatcgtgcgtgcctacgtataagcgaaatatgtcctcacgatatcccatctttattcttgcctggttcggccaagcatccataccgtgtttaatgggccacgatctgaacagtagacaatatgatttctatgttctagcactgggttaaaacatgagtgttgagccaagcaattcatccactgttctttatcccaagcagttttctggcacacagacatctccccactgtagaccaccacatcctccgttaatctcccttatcattcttcatcctccttcctatatccggcttctgttcatactataacttctcatgttagcaaaacacccatccttcctgttcccgatgcagctaacaaataccttttcgaggatcgaaggtctactctttcacgcatccacacttcttgcactgctccttgtaaccagactcaaccaggtacgtgccataagagtcacacttcgaatggggagtcaagcagtgagaatcagggttctgaccgccactgcagtggatggtgtacttggcccgagcagccagttcaaccgggttgggctcaggctcggccactggagttgcggagaccatggtagccaaaaaggcagtggcaatggcgaaggaagtaaaacgcattgttgaaggctggggtaagggaagtgttcgtttaaattgtttggcttttagggatagtagagtagtcagtgagagatgaagctgttgatgagaaagaaggcttctggagtacgggctggtacgagccttttatatctcgagctggatgagtgctatagttctcagtatgtgtgattctggtgaactgctgcaagtagaccaagtagcaccgtgctgacggcgatgatctgaggccttactgctatgtcctctaggtggcctaattgggcgtttgctcggctcaaggtgaatccggtgtgattgaagttcggactggggtattgcacgcctgatcgtcggccccggttgtgtaacgacggcgatgctgctgaggaagctcttctggtaagcattatgcgtagccattcagtgctgaagggagggtattcgcttccacatcttgtcaaaggagtgtagaacatgaatgcgatggattgtgcactcaacacaagcaaagcaaagatcaaagagggtcggtgtctgtacttcctgaggaccatgcttaaatggaccttgaatcggtagggctgactgacgggagtgctcggaaacgaaagcaaggaacaatgcggttgcttcgctgatctccagggtcttgcgtaatacacaacactcaggagcaaacaagctcagcttatgtgctgagaagatcacaaagagcgacaaaaccccgattggcaggcaatatgtgaacaaccctgccatgtatcatgtgactcccaataaggtatatttcctgttcactaaccctgaacgcaacagtcttccatccatccttcatcctcctaactatcctatccatcaataatcatcctctcctcgaatcagttccatcaatccatccaccccacaaaccataaccacaaataacaatcctccaaacatggctccaggcccattctcccgccaacatccttatgagatccacacccccagctggcacgcagcaagcaatcgccccatcgtggacggcaaatacaatgatcccgaaaccggcgaagtccgaaatactacaggcttcgagttttccggaccccctgctgttgatgttatcattacaaatctccatgaggactcgtccacctctgtccggcgcgttcagctcccctttcgtgtggaggcgctgctagtgtggatcatgcgtatagtggatgaacgcaagctacagatagactctctgaatgctactccgtatgctattcgagttgtgctggctcatgagttgagtggggaggagttcacagaagttgctgatgtgatggccaacggaatttggaatgatcggcagtgaaggatgggctggtgagactgggatggacagagtcgataacgcttgtttgcttttttgcggggtgagacccgtaatatggggcaaagggtgtttgtttatttggttattggccttcgggctagactgtccgattggaagttcgactggcgtggggttgtctgaagactcaatgctgtgtaacctacctttcgatagtcttggactttaatgaagcatactgccctatacgagtttttatcacagtagtcattttagcgcgttatatctatagcattactacttaggcagccagtttaggtgcattcaatgtggcgtggattggattttgacacgggattgagtgagcttgggcaaccggcggccaaagatcctaggcgagtttctcgaaagaactatttattgctgagacacttcagccttttactctataatgcaatatttccctcagagtccacacttgcggcttcctgagtccatgtgtaaagtaggtatcgcttttatagcatatccagggtttagatagattcacataagtcagcatcgacgacccgttcaagcaatgctttcagtcttctcaatctcctccctgctcaagcaccacttcttctgcaggtcggcatcaagagccagggcatacacatccttaggccaccactctccccagctagtcaagaagatctgttccggatccgatgggaagtcgttcacgaaaaaggcgcggaggaggttctgggctcctatagacgtctgtcagcaagtcatagtagataataggcaataaaacagatttctaccttccgggataggcttggcatcagtcatgttcatagtcaagcccatttgcgtagcgaggttggtgctgggaataagacccggagaaacagcaacgaccttgcaagagggcagttcgcggcgccagtaaaacgcacccaacagctgagcaaatttcgaggcactgtacactacgcggtagcctgcaccagagttggctttcaagtccacatcaagggttgctataccatatagagtcaatgaatgctagtattacataccaaggatgcgtgtgggatactcacctggatcctggtccctgacaccgcggatcgcgccggaagaaacgaaaataacccgtgactgcgaggcagacagcacatcacggagcaagtggaccagataatgctgggctgttatttatttattccagggttagcgaaactactcatcatcgtgtattagtggtctgccaattttccacctacccagatggttaaccacatatccctggcaccattttgatccattcggaccgggaccttctgccttgtccagggtgccggcacagaggaaaagataagccagctgctcggaacccagcttggaaagaacattcgctgcgaaagactgcacgctcttcagggataggagatccagtgggtaaatggtaatagaatgcttagaggtatcatagttgaggctatcgtaagcagcctgaaccttggccgtgtctcgcgcgcccaggatgaagttgtacggctcggcttgctcaagcaactgcttgactgtttcaaagccctgtggcgtcttagagactaatacatgcaggggtggaaagctaagctcaccaagccggatgagatgccagttgcgacgattgtctttgccatgattgctagtgtgaggctaagagttttattggtatgttatggcgttattgttgggtgacaaggggagagtccgaggttgcaccaaaaatatgccccgcccggagatcaagtggggtattgatgtcatgtggtttctgtcttcttagcgtccactgggttctgaatgataactccgatataaatatcttattggctctttcactgtttaatagcgagatagactggtgagttactaacttacttgtatatgagatttgattaaaatctacaaatcatatatttcatgttgtattttcgtaacaaacacgcttttctgataatagtatttagcgaaaatattttacttcattgacgctggatagcaccctatttatactaacccaagggcaacagtaacgctaagagaggccatttcgatatctctacaatatgttgtaagctcacgagcagtgaaggtttcactggatggtcaaactttccgtggcacatgtgcggatcaggcatggatagctttgagcaacccgtaaccttaacacatactctcgtaggtcatgtgtttatacaaccatcatgatagctcaaggctctatgaggattataaagcacaactgctctcttatagtaagatttgtaaagctgtaactcatgtctctcacaagccattagcggaagatgggatacacgctgtaagcgaccactgagaagatatagaaactcgattaatcatacggttttctctccatgatgtagtaagatcacagtgggaaatagtgccgggaaccctacacccatatatataaaatgagcaagtgcccgtgggggaggggtgtgggtttctcttagatccgtgacactccaaggactcaagtgataggcaaagcacaccaaccatctctaagcatgtttggtggagacttacatctcaggtctttcttgagtgcacaggtgggaatagaggtggcgtgtggagtaggaatttctctgtttaattaaaaacgatgagaactgatattcgtgccgtctaagatggacgaatgaaacgtggctatggcgtgatttgatactaccttagaacgctaatcatgcaggaacagggaaagtaaatagaaagccttatcactagccactagtggtggtcacccgacgtactacagaagtcactcttccctctagggaagccccgagcaggccctagcctcaaccagcctcctgcccctctttttgtctcatggaaattatgctatatcaactaatccttttcctctttagttgttcgttacaattctctggactgaatccatgttagagaatcaaaataccaagcagccactcatcgtatctcacccaaagacgctaaacctttcatacatcatgtttcgccttccccgtgtgccaaccactgatcaaatccttcccctcatgcatcaagttattgatgaactcacccagacgcgcaattcaatactcaaaggaacgactccagaaacagctaccttcgccaacactcttcttccactggcacagactgaaaatgccgtccaaggccagctagccatgattgacatgctgcagtacggtgcccccttgcgcgagacccaggatgctgttcactcagcgttgagtctctatgccgaagcaagggcaagttggatcgccgacgcggggtactttcgtctcctgcaagccgtccgcaacaataaagaggaatatgaaacattggacggtgaatcacgccatctgctcgagcgagagttgacagactatcggatggcggggcatggcgtgctgagtgctgaggaagtggaggggtttttgcaagagggggcgagcattggacagatagagaggaagtttcaggagaatctatcaagggaaaacgggggagtatggtttacccaggatgagttggagggagtacctgcgagtgacctggggaagtggacgccggagggtgctaatggtagtaaggatgggaaagaaaggttatttgtgccctttgcgaatggaggtacattggcagtgttgacctatgctcgtcgtcctgaaacccggaagaagatgtttttggctgataatcagaagctcaagagcaatcagccgctatttgaggatatcatccggcgaagggctcggcgaggccatcgattgcatcatcctacccacgctgggtatcgactgcagcagcgtatggtgaaggatccagaatggctaggtgggtttctcaatgggctcaaggagacactgtgcgcccggggcaaagatgaaattgcagtcttgcagcaaaggaggctgaaagatctggaagaaaggcatgacacatatagtggaggtttccctccgtgggataaaccctattacatgcggctagtagaagaggaggttgccattgatcagctacagctatccgagttctaccctctcgagcaaacagccatagggatgctgggaatttttgcatcagttttgggtctccagttcgaacctgttgaagctgaggcagaggctctctggcatgagtccgtccgggtattctccgtctgggagagtgcgcccagtaagcaattcattgggtatctctattttgatttgctgtggagagagaataaataccgcggtaatcaaagcgtgaatcttcaatgtgtaagtgccaatcacgacattagcgatactacgcccgatttagactaacataggatgtcagagctacctccgaccagatggcattcggcaataccctgccactatcctaatgtgctccttcccgactccttaccccaccggttgtgcgttgctcaaacatcaccaagtggtgactcttttccatggtaagctctattcagataatcttgagtttatcctaacgaaagcacacagaaatgggtcatggtgtccatgatcttcttgcacgaacgaagtatgtccgttttcatggttaccggcttcctcctgatttcggagagatgcccagtatgatgctcgagaactggtgctggatgaaagaggttctgcagggcctcagctgccactacaccacactagaccaaaattacttgaatgagtggcgcaagcaatatcccaactcgcccgatccgcctaagaaaatttctgaggatttagttgaacgcctgatcaagcaccgttacctaaaccgaggcctgtatcatctttatcaactgtatgtctcgccacaatgtctttggattatattagtctgacttgagcaggtcaatctccatcttcgacttgcaaatccatagtctcaagacagatgcagagatttttgatctgaatgttcaaaagctctggtatgacctccgtgaggagatcgaaagcatagacttttccgagtgccgaggcggctatgcatttggaacgttcagccatctgacagcgggctatgatgtctgctattatgcctatcttatgtatgttcttcgtcttatccgagacagtctacttcattgtatgattcatgcgaactaactgtctaaaagctgtacagcgatggcccaggacgtctttctttctatgttcgctgaggatcccttccagaatgataagtgggagaagtaccgccgcgaaatcttacaaaatggtggcagccagcaagacctgttccagatgttggagagattcttgggtcgtccgccaaatatgaatgcccttgtggaaggtctgaagcgggcagacagtcaacatgaatgttagaggaggcggcatattacaccataggcttttcagacaaaattactgcagaagtctcagccacgcaatgttaccatgccacgccaatcaggtcagctgcttgaattgggttcagaatccccaggaacccgagcggcccgagcctgccgagagtcacagacgatgcggagggccacttggcatccaatgtctgcgttttatgatttccagagcatgtctatcttgaccatataagccacaccgtagtgctatgtcatagactgtctatcggaagatgtccagtaattgtccgtgtttcttacagatgctcgggaagtcaatagactgcagggctcttcatgcgtcatgatataaccgacggcacctcctttgggctgtgcttagtgggtccggtaagctagacattcaagcgcagccattcacagcttcagtccaaagacatgaccgaatagtagtatcctaatagagttcgagtagcatgaccacatggtgtgaagaacatgggttcccctcacggcgccggttaaaagccatcccctcctcaaagaagaaacatcgtacgacgtacacgggtcggttgtttcaactattatatttcattctaactatacttattgcaaagcggaatttgttccgataatcatacaaggctttcaggggtagtcccatctcaatatccggggtaatgacatccaagtcgtacctaccaaaacttacctattactcgaaagtagcactgcctccggaaaagcattcaccaaccctccacaaaactaacttccacaggaatgcggcacctccattccctccacaattaccgaggcttatcccaggaggaacagatccctgaagaaacgtgacgaaccgtgatgagcgggcaatcacagattagcctcttcccccgcatcccccgacgggcaaaaccccggtggcactggcattagccctaggcacggacaaagccattgtcaagccttcaggaactaaatcaactaaatctgcccatccctgcggggtacatactccacgacgccctgcacgcccgccggaatgccgtcgtcgcttgacatcatgtggaacaacacattccttctgcctcaaaactgagccttttaaccgaccggttacttaacaatgtatacaggaggtctcaatattggaggaaaatccctgacccctgaagccacacatgtaactagacttttgggatcttgcatttcatgcataggcactgactgcagtaaagaatataaataagcctcccttcgcaccctagtagcatgatttctttctccaagcggcctatctcactgtctcctctcctagcccagaacttactgagcaggcagtaatcctccaccatgttctcccgccgaaacctcgtcgccctagggctggcagccaccgtcagcgccggcccctgtgacatctacgaagccggcgacacgccctgcgtagccgcgcacagcaccacccgcgccctatacagctccttcagcggcgccctctatcagctccaacgtggctccgacgacaccaccaccaccatctccccgctcacagccggtggcgtcgccgacgcctccgcccaagacaccttctgtgccaacaccacctgcctgatcaccatcatctacgaccaatccggcaacggcaaccacctgacccaagcacccccgggaggcttcgacggccccgacgtcgacggctacgacaacctcgccagcgccatcggcgcccccgtcaccctcaatggccaaaaggcctacggcgtgttcatgtcccccggcacgggctaccgtaacaacgaagccaccggcactgccaccggcgacgagcccgaaggcatgtacgccgtcctggacggcacgcactacaacgacgcctgctgcttcgactacggcaacgccgagaccagcagcaccgacactggcgccggccacatggaggccatctacctcgggaacagcaccacctggggctacggcgccggcgacgggccctggatcatggtcgatatggagaacaacctcttctccggtgctgatgagggatataactccggtgatccctcgatcagctacagctttgtcactgccgcggtcaagggcggggctgataagtgggctattcgcggtggtaatgctgcctctgggtccctctctacttactacagcggcgctcgcccggattactccggctataaccccatgagcaaggagggcgctatcatcctgggtatcggcggtgacaacagcaacggcgcccagggtaccttctacgagggtgtcatgacctccggctacccgtcggacgatgtcgagaactccgtccaggagaacatcgtggctgcgaaatacgtctccggctcgctggtcagcggcccgtcgttcacctccggagaggtggtctcgctgcgtgtcactacgcccggttacacgacgcggtatattgcgcacactgacaccactgtgaacacgcaggtcgtggacgacgatagttccaccacgctgaaggaggaggctagctggaccgtggtgaccggtctggctaatagtcagtgcttctcgttcgagtcggttgatacccctggtagctatatccggcattacaactttgagttgctgcttaatgccaatgatggcacgaagcagttccatgaggatgctactttctgtcctcaggcgccgttgaatggagagggtacttcgttgagatcgtggagttatccgacgaggtatttcagacattatgataatgtcctgtatgctgctagtaatggcggtgtgcagacgtttgattccaagacatcgtttaataatgatgttagctttgagattgagacggcgtttgcttcgtaaggggggaattgggggttggttggtggtttgggtgaggggttgtatctgcctgtgttggcggggagagtggtttgtaaataggttatttttggtatatagcacatgaatactatacgatagtatacatgatagtggttgtttcatgtaatcgagaaattattcaaggcttgcaatacaatatcttattactgtatctcgtggagcattcacagactgaacggctgcacaatgattcttatgcggtgatattgactgtgattagatgatatattcaggtgtgctatttttcttgtatttatgcttcatgcgaatatatgtatttcacgacaggcagagaggttaaacaaagcatactaacgagcgattcagatatgacatgtatgaataagacaaaagtactgcgacactcaagaccaacacaaaccagtatacttcataacaatatatgctaggcagtacctccgattctacgatgagctttaccagaaaatggatttctttgtccctcgtcattctcaatttttgggccttccacggctgcggcaacctgttgagcaagacgtgttctctcgtacggatggacgttgatcttcttctcgagcaggtccaattgctctttctccaaatggcggactctgacctcaccggaggaatcactcggcaagcatatctggtaagtcgctgaaaatttcttctcgaaactggcgtagcttggtggccactgcgggaagcgtcggaagtatttgcctgtccagacggtcaatatgaatgagtcggatacttcaatgcccgcctgccttctacggtcgaagaaatgctggccgatgcttctcacggaggcatagtttataacaggcttgatggggttttgtatgtcgaggagacctaattcaaagtgcatagataggctcctgagattgtggaaaccggttgctagtttgtcgaagacgtcgttgggctgttgtgtggttatagttcagttcatgggatgtactaagaggattctttggcttacccattgatcgttctctctcttgactcccacctgcagtgacttcagtttgggacagctaacatcgaggtggctgagctcctccgcagttaggacttgtcgcggatgcgccgtggaggcagattcttcttcgtgcaggcacagagtagataggttactatgacgagcaattgcctcaactgggcacatgatccctttcaaaaccagagtttccagagaatcaaaggacgaaaggagttcgataagtccctctcgctcatacttgccctcgccttgccagctacacacattaagacttttcagtgacgtagcatgcccggctaacatttggaacaggccagcgcaacgctgcggtcctacagcgagtgataccaacttgtcccactgaagcccatcacgccaatatttccactgcttgtcgtccaaccagtatccgtcgagggagagatgctcaagtggcgggaaagtttcttcgcctgtaagctgaaagctccatatgacaggatgccgaggcatccttataacacaaccaccatattgttttacgacagaaagcgagaatgaccgtaggtgtgggcatttgaaaaacaacttttgcaacgtgagaatctgccgatttggcccgttctggtcatagcttgggtccacagaggcagagagagtcgtgacacagggtaaaacctgctccgccaggctggagattttatcctcgcttttctgatccagtaggagaagttctggcttcctactatgttcacaaatggtacgaatcaaagttgtcgattgaatactgggaaagcctatggtgatccttcgaaggtttggcagacgggcaaccagtgcagccaagcaatcattgatctggaggcgttttaggaatttcgcgtctacccaagcaaaggagggactcgaaacgttaatgtcctgtacccaggctcgtaaggtgtcatttgcgtcgtcttccagtcgagatagtagaagccaaggacctctcggcaattccggttccgttttcgcttctgtagatgttgacaagtggcggcgttcagaaggatccttataagccaccagggagatagatcgatacaaaagaggtgtcgcaatggagttaaagaccttgtcgaccaagcagagctggcacaaatcctgagtggtgcacagctcaagtacaagacgccatacatccaagcttactgcatctctcatcatgatgatgaatggtatataactcgagcgagcagttgaagctgcagagatgattccagtaagaaatatgtagaaactgtcaagaaaatgaagatttccgtaaattttgaggctatataatcatcgctcaaaactataatcaggtgggggaaataaggcagacgtgaagtatttatagtgcctaagtctaggagacgaggctctgcgaccaagcattcactgactcagtgcggagcgcaagtgaagtgacgccatgcatttgattggatattggggaagacaaggctgagaaagaagcaggggcttcaatggaggggaagaacaagccaccgccgggagtaagtctgattggttggagagcagtcgacagccagtcaccctcacatcagctgctttatcatggccctcactgtctcccaggaatggtgtgggacatgactagcctggtcccggacactcaacaactgcgaaactgattacaagctggatacgcgtgcagagaaggctgcatatgaaaagaagcgtatatcgtacaatctatctatctacagattattgaggatcctacaacttctcggcctctgccatcaagtcctcaaccttgaagttctgcacgtcaccgcgagtgaacgcctgcagaagctcgcctttccgaccattagcctgacccccaaagtcatagaaccgctgaacacagctaaccagccaggtggcatctgtagcagatactccggaatcaggcatcacctgcccattcatcagaaccagacccttctcatccgccagatccagataatgcgtgatcgtcgtatgcggctgcgcatacgagccatgcagctgatacgaagccaacgctgtgaagataatcgtggaagtgtgatcgttggccgaggcagcggaagaagcggtcggggacgctggaggatggaaaccccattggaggaaatggatgtccgcgccgcccttggcggcttctgcgttctcctccgcagtctgcgcctcactctgcgtacggggtaggggaagaacgaattgcgggttcttgcgtgcggcggagacgatgcgctggtatatttctaccggaattgcggcgcagaccgaatgagagttattggcgaaacgaagacgccagatggcctcgatttcctttggcggaaggctgcgcactttctcgacgtcgatgaacgagtcaagaggtctgattccagtcgatgtggcggaggaggcggcgcgagcctggggagtaggtggaggaggagggggtgaagggccggtcttggacggggagggcgaggacttgggcggctccggagtaagaggagttgttgctttgtgacggtactcttcaatcttctccttgtaggcttccttcaaagaatcgatgtctccgtgtccctccctatggtgagacaagtgagtgagtcggtcatgactactgtcgcggtcgacttacgcttgggctttctgcttgagtttcgagcggtacctgtccagcacttggttgggatcgtggtgtgtggcgaggaagcggacatcgtgcacttgggcccagcgcctttgctgggggcacagggacgatgcccgagtcctcaacagggacttgaatgcagaagatctgaaatacgccatcttaagactgctgctctgaaggagcaaagaaagaaggttaatacttgggaagaagtccggccggttgagctgatcgggactagcgttgattacataatatatgcataaatactgccatctcacggcataagcagaagatgcttcaaaccatagctagaaattgcacagtaccaacgtgaaggtgaacagtagaatatgaacgctgtatcaatgtaaggtactggaagaatgtcggctaggggaatgggtaccgcgtagcagttttccatatgtatccacatatggaagatcaagctccctgcaagtctcctgcccagaaccttcaagggtgctgagctgtagaaccaaattaaagataaagtctgtattataacagcttatattatgtagtactaatatatataggagaactactgtatctaatcagcgtctgagctcatacgtatatatcattcgaacaaggcactagatatgaaggtgcctatagcctcctcaacactagaatttctgcactttctgggtcatttgaagtgcattaggggcaactgacagactgatgtgctctctggtccataggagaaaagttaagctgattcatctcagtagtgtcgctctagacgaactagactataacgatcgtccggcaaccactcatgacgggatatatgggcccgcagtgtctctacggaccgggtgtgactcattgcttggagttagagaatgattccgctgcctacagctatctgacagttaagtgttatacattcagtctgttctcagttcttctcgattggcaatccataacatccgcactatagcgaaagcagggcgtcattcgtctaagacgatcgatagatggcctggccatttacgttcgtcctgcaaaagtgctctagtgccattccagtttcctggggaaagctgctcatcctactatctattcttagccgcagtagtggggtactaagggagctctagagtctagacatccttggctgctcttcggcttactatagaaccattccctttagtattgcgcccagtcgatgcttgagtatagtgactagagacaaattcgaactagtgataaggccgagccagtataaccgtcagtatctcacaaatttttatactccatctaataatgatatcagctaaaaagatgcagaattggaaagcccaagtggaaacaaccggagcatatggacagataagtaattgctcccgctaggtctactataaatttaaagacagacgtcaggtagcttgctcaacgtagttccgatattttactaccagataacttacttctacttaattcatgttgatcatggtggtgagaatgattctagcttcaactacaggaacttaactagtaattgcggaaacgaagcccggcaacttatatactgcgtagttagtccgtgcgatcctttttcggctttcaagaattgactgggaagtcaaagaggctgatgatatttcctaattccattctttgtaattgttttcagatcgcatgtattcatatgcgctcaacaatacatgaggactgagttttgtgggagtgcacacaactcaagaacctaatccacagtacccggtgcccttccccgggtccatatcggaggcctcttattagccgtcggggaagtactgcacgtgactacggaaatgtcccctcctctgtcctgttcctagtatgttaaaggtactgaatctcggcaattgtgtgaagctggagagaggtatcatctagctactgtattatcacctccaatgctatccaggactcataccgagcacagttcccttcaatattgtagtgagtcattattcacggagattacttatcggacgaggcgataatgacttcccctatcgatgcggggagatccacagtctctgattggttgatttccaataatgttacgtaaggcactagctccgactccggatgagtcaacgacctgcatcgaccgcctgaatgagccatcgcgaaaactgatcttcccagcgatcttttttctttcccaagtctcctctttcatccttctctactgcccaacaacctctctcctcgccgctctatccgatatccccctccaaaccccttcacataatcacaatggcctctgaaaagccccgtgtctgtctggcctactccggtatgttctcgcccgccccgaccccgcatattgcggtcttgataaggctcgatgcactaacttgacaattaccacttcaggcggtcttgacaccagctgcattctgcgctggctcatcggtacatttttctccccatttccggtcgaattccgatcggctcgactaacaattgctcacagaggagggttacgatgtcgtctgcttcctcggtaatgtcggccaggaggaggactgggccgctgtcgaggccaaggctctcaagatcggtgcgaagaagatgatcatcgaggacttgcgccgtgaattcatcactgagctttgcttccccgctatccgtaagactgctagtccggctacgtgccccgatctgtccgctaatgtctcatctcagagtgcaatgccatctacgagggccgctaccttctcggtacgtcatgacgctctgctaacacgcccgggacaccaattgacctcctctaggtaccagcttggctcgccctgtgattgcccgcgctcagatgcgcgctgctcagcgtgaaggctgccagttcgtctcccacggtgccaccggcaagggtaacgaccaggtccgtttcgaacttgccttctacgccatccagccctccatcaaggtcattgccccctggcgtgaccctaagttcttcaagcgtttcgctggtcgcaacgatctgcttgactacgccgcccagaccggcatccctgttacttccaccaaggtgagtggtgtctatacagattgcgcaaacataggctaatacaatatgatataggccaagccctggtccatgggttcgtcaaattgctcttccgcgcgtaatttttctaaggcatactaattattggtatagacgccaactctgcccactgcagttacgaggccggtaagtgaaccattggaagtaaattaccctatcgtcttactgacaagccaataggtgtcctggaggaccccaaccacactccccccgctgacatgtggaccatgaccgccgaccctatgaccgctcccaacgagcccaccgacctcaccatccacttcgagcagggtgttcccaccaagcttgtcactcccgagaaggagtacaccgaccccgttgagcttttctacaccctcaataagatcggtttcacccacggtgttggccgtatcgacattgtcgagaaccgtttcattggcctgaagagccgtggctgctacgactgtacgtgttctgcactccatactgcacgcccagctaggtcgttgctaacatgttgcagctcccgccatgaccatcctccgcgatgcccaccttgacctcgagggtctggtcctggacggccaggtccgcgctctgcgtgaccagttcgtcacccacaactggtctatccagctttacaacggatagtacgtgcttcgccaatcttattctatagagaggtgttctaacccgcccacagctacttcagccccgagcgtgagttcatcgagaacagtctcaagttctcccagcgcgtaagtccccgtaaacccgaatttagctggcccgcatcatctaactaagcttaacagcgcgtcaacggtgaggtccgtctccgctgctacaagggccacgtctacatcctcggtcgctcctccagcaccgagaagctctactccgagcaggaggcctccatggactccctggacgacttcgagcccaccgacaccaccggtttcgttgccatccagactatccggtacgtcctaccccagtcactttatatctgcctcgagtggaagcataagctaatatttcccgtcctacagtctgaagaagtacggtctccagaaggccgaggagggcgagtccctcagccgtgcatgaattatgaatgagcgttattgagtcatgggtgtacggggaaacaaaaagtaaatagatcacacaaataataccaatgaaatattcaaggcaattaatccctttaagcaacacttaccattacgtgtaacctatcttctaggccagatgcgcagccaattcctcggaaagtcaatcgacagtactgaaatgaaccaaacccgtctaataatagtagggttggttctcaatacacccgaacaaagcattatccacaacccccattatccagtccacttatctagttcctaggacgacgacgacgccgacgacaaccacagcccgtcccacatctctcgatacaagacatcccattcctaattccttgacctgttgtccgagcaaaccttgccacgcctgctgacgcaggtacccctagtgtgacgatacctcatgatcgaaacctaacaaatcagcggcccctgattttcatccaactgacgatcctcccagtggagcagccgtcaaaagactttcggctgacaggttgctggttcctaatgggtgggacgcggaatgccatgccgacgggggccagcattccggccatgggggggcgcgacagcaattgttgcccacggatacatgaaacgaaggatcccttcattcttgaaaaaaatgttaccgtgggaggtcgatagtgggaaaagaagaaagcgttggatcagagaaagtttaggctgttgccatgagccacgacagccctcgacgaacagacaagttcactttaggggggtgaaggttggaatgcatcgtcaccccaggggatgggcgattatcagtgggctgtgtgcataccttgggggaagtctcgttgctagtgctggaggggatgatagtggcgctgaaggggggtataaagatggtggtttttcgaggttgagatatctgttttctgcttcttcaatcattaaccttctatactttgtcccttcgaggaggtacttgatcctatatctctctgtgtggatatatataccagacaggagtgaaattctttaccaaatattgagcagcagtcaaaaacaccaaaatgaaatctgccctcctcgcctacggcctcctggcctccgccagcacggtcacagcccacatccaaatgtccaacccttacccgatccgcagccctctcgaccccaacggcgacgagtccaaaaaagactactcatacacgaaccccctcgactctgacggcagcgactacccctgcaaaggctacgccaacgaccccttccgctccgtagcgagctacagccctggaggcacctacgagctggacctgcaaggcagcgcgacccacgacggcggctcatgccagatctcgctgtcgtacgacacagggaaatccttccaggtgatccactccatgttgggcgggtgtccgctcacggaatcgtacaagttcacgattccttcggatgcaccgacgggcgatgcgctgctcacttggacgtggttcaataaggtcggcaacagggagatgtatatgaactgcgcacaggttactattggagatggcagtaagaagagggatctggaggagatgcggaagcgagatgcgtttagttcgctgccgcccatcttcattgctaatgttaatgggcctgggcagtgtaccactatcgagaactatgatgtgaacttccccttgccgggaccgtcggttgagggcagtatcaatggtactgatgctgggtttacttgcaccggggatgcgcctttcttgcatgccagtggtagctcgtcgggctcgagctcgagctcgagctctggctctggcgccagctctgtcaaggctgcccctgtgtctacctccaagccgactgtgtctcggcccactgtgtcaacctccaaggttgctgctcatgttgccagcacacccgcagcgtcatcatccgctaaggtggttgcttcgtcgtttggaactgaggcagcgcgtgtcgcgaccgttgccacggctgctgcgcactctaataatgatgctactgttgcaggtgctgctgctgatgatgagagtgcccggtacgtgcctggcaagccctgcgtcgatggagccattatctgcggtcctggtggtactagctggtcgatgtgcagcaatggacgtcctgtccatatgggatctgttgcggccgggatgtactgctctcatggagcgatgcaacggttgcgttaaggggttggatgtatatgggtgttttggcagagttattgcatcgtttgtatgatgaagggtttggtttcttccttcattatctttcttggatgatgtgtgttgatgaccggacggatgtgtttactttcagcggctcatttgttctctatgtatcttagttgtctcatttttgagtagcctatgtagtgttacgtttgaatcaatttaaatgaccttggatgatataccagaccctcggcgaatgcacgatagatataggctgtcgaagtaaagctagatgcagtgattgaagtatgttgtgcgatgcatcggttgaatgaataggcgtcaactgcccgactgaactagaaacatacttgtcctgtaaggtgctagtcggcatggggcctagctggttgcgggatggtcgccatcggtgatcaatgcccttgttcagaggcgagagaaaagtatcggtgcccttgtacgtctaagtaatagcgaaataatcgatttgcaaccgaagctaggtcgtggtattcgtagtcatgatgaagagtctacacgatcaatgtatagccttgaatttatcgtcaattctaagttctatcccgccgtctatgtaccaatgtagcaggtatcaaaataagaaataacatagatataaatgtcccgggatccagtagcatagatcatgtcacgtcacaggtagaatatatgcacagaccgagaaacagtaattaacttttagttgtagatcgttttgggaacactcgcggaccaatttaagcctgagcaaccacggcttccagagcctgctccagaatcttgaggccggacttgatctgctcctcggtgatggtcaagggaggaacaaagcggatgcagccctcacctgccgtgataatcagcatgccgcgctcccgggcagcaccaaccaaatcaccggccttggagacgaactccggggagagctggagaccacggatcaatccccgtccgcgaatttccgagatgacgttggggaacttcttctggagatccttgaatccagacaccagcaggtctcccttgatctcaacagacttctgcagctcggggtccgccaaacggttgacaatgtgatgggcgacacggcacaccagggggtttccaccataggtggtaccgtggtcaccgggcttgatgtgtttggccacggtcttctcggagacaatagtcgcaccgatagggataccgttacccagggccttggcagaagtcaggatgtcggggtgagcggcctcgccagaagcaggcgccagagacgggtgggcgtgagcccagaaggagccggtgcgggagagaccgcactggatctcgtcgaaaatcaaaacggcgccaacctcgtcacagcgcttgcgcagagcaaccaggaattcaggggtagccacattgatacctccctcaccctggatgggttcgacgatcacaccacaagtcttctcagtgacgagactctcgagctgagccacatcgttgtagttgccgtacttgaagccaggcagcatgggggagaagggagtctggtacttggggttcggggtcgcagaaagagcacccatggtgcggccgtggaaggagttgtggaaggagacgacttcgtgctttgcgccggaggggtcgagcgaacgaccgaccttgcgggcaaacttgatggcggcctcgttggcttcggttccagagttgcagataaagacctgagaggcatcgcgcatggcaccggacttctgagtaacgtcgatcaagagcttgctcagagctccagtccacgcattgtagtagaggttcgaggcgtggacaagcacctcggcttgttcagcgatgatctgggccacctcggggtcacagtgtcccagagagttgaccgcgataccagctgtcaagtcgaggtatttccggttctccatatcccacagataacatccctggcccttgaccatgaccggcgccggccgcacgtaggtcggcaacatgtagggagattgatcattgacgaaagcgaccgatacggagtcagcagcaggatcggggttcgggacagaagccttgttctgagacttcacatgttgcgacatggagaagaatcgctgctgaggcagtgagtcaatgctggggacgagccgacgggcgacgggcaaccgccgggcggcgagacgtgcgaacgccatcggattgcaaggaattgggggtgggaagatgggaacagggatggaggaggaagaggttgaaggcaggcgacaccagcgaagggacctgtatatcaagagaagatcaggcagctggaattgacgttgggagcagaaagttgtaaacccaagagttgactttctgctgtatctcatgcggcatcggcgctgccggatcaggtgactggccgccatgtgactcacgctccgcttttaatagattgataagagtagcatagcgggtctatgcttaacacattgaaaagaaatgtcttacatctagactaggctttgccttgaacaccagacaaaagtagacagttgtacccccgttactgttagacatgggaaattacacctcaaacttacccccaagtcgctccaatttctccgcatttcaggcacttttcccattatatgagtatattaagcacccccacggaatgtaagcaccgattcacgaatcctggtctctggcacctaggcaagacttcgttccatcttcagcacgaacttcaacatgaggcatggtccggtagggctacttttgtgaaagtaccaagcattggggggttttctgatgggtaatttatttcttccatagaaagtattggctggattagacaaactgtttgttctcagaatgaaagccggaggctctggtaactttctgtgattgtcagtcatagcaatgatttttaaatcacccacggcttcagcgtgggatacacttcggacgcaaagcataatcctagtgacttgcgcgcagtataacactgctaataattcactcggccggaagttgtccgcggtcacgtgccaacagcgttggcaacgcagcgctccgaaaatggaataagcaagcctgcaactgtgtatcgcaactgtatcactggcttccagaggtccatcacttgccgacagaacagccgtgatatgttcgacagttggatgttaagtgctgagtaatgcatggacaagaattggaagagtcaggtaactggtcaacgaaggattgcaggagtcatgtggaaggcgccaggaaggcaggcggtggggcggcgcaatatgacgcggcatcacatgtcagagcgatcgaattaggttgaggcggaaaagaggttagaaggtgagagagagcagctgttggtacgatggagtaattaggcgccgggcaggattggattcagtagtttccacgactggatggtgagacgagtcatgattcatgggctgcgaacgtgaaaacccacggccgacatccgagtcgcggcgcatgtgacacctgccagcagaaatcagagtcctcttagcaagttccggacatcgtaagtttgacttggatggaaggagagggaaagcacatgtgcatgcgagacagtatgacaatgttgtaaaaacctggtagtcagtaaggatggatactgtaggtagatggggagagttgaagccattcctttggttagtaaactgccagtcagcgcgggggaagaatttcccagcgcgggagtgtgattgcacgtgaaagtgccccaacctcagcagaaagcaagcaatcaattatcatcgcaaccagacacttccgacaagggatcttcgtccctcctcccacgcccattgcgaaccgatcttactcctcaattcttgccctccccttactcccactagagccaatttcaggctccatccattgccctctttcctttttcgggccctccgggcagccatggactaccgctccaacggcaggtcggtcccgaaaacctccctctgtgagcgcccagacgccgtctcagcgcccactggccctcatacttcagcgctatctactgcctcaccctcaaccgactcctcatctgactcggcccctcccactgcctatcccccttttcatcatgttcctccccccatgatggacgtcgatcattctaccgtagcggaagaccgttcacgtcgagccaccagtgtactatccatggatgatatcgaagccgcccaagccctggagggccttcgcactggtatgtcttttcttcctcccttggcccttggcctgtccaggacgagtttaacagtcgatggtatcagactacggtcaatcgccgcgaacgtcgcagatgaaccgccccgaatccaagcagcaaccagagccgctcctgtcccttctcacctccacccatcctcttatctcatccgctataaacggctcggtgtctgcctatgcaaattccaaatcctattcccctcgtttcaaatccagcgccgaattcctcgagcgcaacattggctctcccgtcgccaacacggttggcaccgtgggccggaagactggcgtggaaagtggccttcggtgggcgttacagcgtcgggtatcctcgtcagcccagtctagtcgttctaaacgccgtaaggttagcagcgagcaacagtctacggaggtcgacgtagagaagggcccagatctggcgatgaggctgtcgccgggagagggtcccccaccctacgatgatcagaggtctcccaattatgacgagatcggtcgagacagtccgtcgcggcagactccgtccacatggcagagtcgactgatgatctcgacatccggcctgggcgtggcgatgagtgaggaatcgctccgaagcctgcagtattgtctgacttggctgcgctgggcgaatggacggctggacaaagcgattgaggccctcaaggccgccctgaaagaatgggatagctcaaggcagcagaatggggattctactgcagagcaggacgcttccagcaccaccgtcctctcgaatcgcatccaggccgtcaaggcggatgtgctggcgacgctgaaacgcgtggtggacattgtctcgaaatatgccgggggagcgctcccggagaatgcacggaacttggtgcgtcggcatcttacctcactgccgcatcggttccagatcgcgtcgaactccaacccgccgccagattccatggcggcggcatcggacgccaccgtcagcgcccatcgcatcctcgtcttggcccaggagggcttggatatgatgtcgcaggtcagcggcgtagttaacgacactctggtcagcgctgagcattggtgtgaaaaattgggtcggaagcgctcagagggcaaggcgccgatcgaggctccgccccgagagcacgatgagccgtacccggcggatatcaaagttccagttcaggagccatcccctcgagatgtctccatgacaggaatggagaaggtttagtgatgctatcagcgctcggcaccgtacgatgcaggccactgctcccgtgcttctgcaccagtctgatgaatgatcatagttcttcacttattacacgaggtctgattacctcccttctttacctctttgtttctttgtgttattcttattggtcactgtatcgcatttagttctgctgtttgcagcttccttgaccactccttgatatcactgtttttcttttctcctgcggcggatgaatggcgtttctcttgtttgactggctgggcggttgggttggaactggatacctggattgtttgttaaatccaacctggtgcatctctctttcctgtgataccacccttttctatgaacctacacagtacaatgatggctccagtgatgaaaagttcatgacttgaatctgctttattcctctcatgcaccgacttgaattggagctctcccgatgcccttggttggatgtaatgatccgggaatcggccgactcccagtgtgagcgtttgtgctaatgaatatttgattctgagtatgcgtaaatatctaccttgtcgaaaagtcaatatcgtagttttcctctggtagctatcgatgtagttttgtacaaagtaccaggttgcatcggcatcggaaagaatgccgagcgggaggatccaccaaccagctttttatctccgataaacaccatcatttcacatccctcgactacttcctacttcttttacactacccaccaccaccaatccactacaccacactatcacaatgcgctaatccttcaacaccatccgcagtattcgccatgtcactgcccacttccacctcccccaatggccccgcgccccaagacccaggcgcatcaggcgccgccaatatggaggagaaaccatcaccaccactcgaatccgcaccacaacaaccagaccgcgccgcagaacccaccctccaccccgcctcccacaaactcacccaattctacaccatctcctatctaatcttcttcgccatcttcggcactctcgcccggctgggcctccaagccctaaccttctaccccggcgcccccgtagtcaccggcgtcctatgggccaacgtcggcggctccctcctaatgggctttttccaagaagaccggaacctgtttcgcgaagaatggggcacccccaacaataacaatattgacccctctgagcgcgcaaaacaacataaaaccatcaagaagaccatcccactgtacatcggcctcacgacgggtttctgcggctgctttacgtctttctcgtcgttcattcgggatgttttcctggcgcttacgaatgatttgtcgactccgtcacaggagaatattgtttcgaggaatggggggtatagcttcatggccctggtcgctattattcttatgacggtttcgctgagtttatgtgctttgttgtttggaacgcatctggctgctgcgttggatagtatcactcctactgttccatttcggttcacgagacgggttctggatccgctcatggcggtgctggggtgggggtgttggcttggggcggtgtttcttgcgatctggccgccggatcggaatgatggtgggatggaggtgtggcgtggtcgtgcggtgtttgcgattgtgtttgcgccgttggggtgtttccttcggttctatgtcagcttgttgctgaatgcgagggtgccgagtttcccgctggggacttttgcggtgaatatcttcgggacggtcgtgttggctatgtgttacgatttgcagcatgtggggagcattggagggggtgtgttgacggggtgtcaggtcttgcagggggttatggatgggttttgcgggtcggcaacaacgattagtacttgggtggcggagttgagtgcgcttggggctgctggggggaggaagagatgggcagcgtatgtttatgggactgtgagtgtgggtgttgcgttggggtttgtggtggttattgttggttcgttggggtggacgagggggtttgatgggccggtttgtgggtgatgagaatgtgtgggtgtagattgtagtgtatatagtataaatataatgtagtatagtatagatgatatatatgtgtaatgtatagtatgtctttggtttcattactcattgagtcatctcggtgtagcgctacttcacgccttatcctgcgaacacttgctggctggttgtctcccagagacgcatggaaacatccagaccagataataggtcaactgttggaggtctttgtagacgtgagacttgtccacaccttccggaatatggtacaggcacatccccttcagggcctgcgaagtgccctattcagttccggcacatgtactccagctgcgcttgactctgcagtggccttaccactgcgacattgctatcgcgggattcgctgctcaatcagctatagtcatagtcagttgaatctatatcgccatcacttcacatccatctcatcaccctctcgtccccccgacacagaagcaggccccttatccttcccctgcccctgctggtgcccctgctggtgcccctgctgctcccccgtcggaaaactgaggtacttccaatcctcgatctcctcgataatacacttcaagcgatcccgaatactctccacggcatacgtccccaaaatcagcctcaacggcggatacgagcaatgacccaactgccaaaccaaatgcgccgccttaaccgcacttgccggctgcttatcccccaaccacatgagcatgcgcttcgcatgcgccgccggcgacgtaggcgtattatacggctcgctcggcggcttgaccaagaaatggccataaagcggcaacggtgaccccagcgccaaattgttggcactatcctgctcttcctccgcgccatacccaccaccgccgccaaagatactctcctcaacaccacccaccaaatcccccacatcatcgcgtctcatatgccccggttccaccaacgtagtcttaatattaaactgatccacctcgtagagcatactctccatcaacccctcaaccgcatacttactcgcacagtacggtcccaatcccggcactcccagggcccccgacgtcgaactgaaaatcaagtaccgcccggccccacgctcccgaaaatgcggcaacgacaactgaatcatattcaatgtgcctgtgaaattcgtctcgaactggtcccggatatcgtattcgtcttggtcctcgcacgccccgattactccgtacccggaacaatttgcgataatgtcgatgcgcccgaagcgcgcgatcgtggcgtcgattacgcgttggacggtggggcgggcgcgcacgtcgcagagtagtccgaggcacttattggggtgttcttgttcgagcttggacatggctgcggggctggtttcgaaggtgcggccaacggcgctgacgaggtcattccgcgatagagccgttttgacgagcgagcggcccatatggcctgttgcgccgaagatgagccatactaggggctttggggggttggaggggcccggtgggtcggtggtcgaggggagttgaagcttgggttcgcgggtcgatgtggttgcggatgcggttggggagacggccgatccggggttcttggtgtggttatggggggaggtgtagaagtccatgttgtagtgttgagtgggggagagaagggtagtatcccgcgccacttgggctgtgagattggggcgtgtgcccgattgaggtgaggagatgtaggagtgactgggtgtatcgggattggagttgaggtgaagctgtcgggggattctacagactcccgaactactccgtacttactccgcaccgctatgtctggggaaggtcacgtgggaggtcacccgtgcgtcttttatccctaagaaatactatacgggtctactatagagatgtacgcagtggaacaatctaacggtcaattttcactatagcgttattgagatcatgatttggtagtggctgcgcagcttcttatttctggtcggctgcatgtctgggactccgacgcaggcgcttcgcgggcggttcagcatcccggtcagcaccaacaatggcccaattttcatcgtcctccggggacgaaacacgctctgtgggcttctgagtcttgtcagactgttgctgttgcttccgaggatagtacaaggaaatggtgaataactcgaagttcttcgtggtatcatcctcgtctttggcggattcctccgacgcctgtctctctgcagtttccttggaagcattattcgacgcggcatcatgagatttggaaaatatccgggagaaaagagatgcttgcccgccagtctcgaccgaatcctttgcttgcttatcatctgtgggctcctgttcctcgtcttcttccgcatcgctaaactcccacatctcttggatctcctttctcaccaatgcagttccccacagagagatcaaaaccccaggtacaaggtacaggagcgcaggctggggatggtcaaacacctgcattacgatcagagtcgcaagcatacccatgacatatccaatgagactggcggtgaaataaggcttggggaaagatcgggcgttgtggtagggagggtccagctgcggcttgcttggtaccactgaacgggtccagaaccgttctccccatcctcccagcgcggactgatatacaggcttgactatttctgagtccttgccctctgctcgcgccttttgctggcccttgcgcttgtagtagagataaagatcgaaccggagtgccaggcctaccatcataccgggaatgatgatgtcgcccagtcccagcatagcaagggagatagtatcgggtgcctccccaggcgctgcagggcgcggaaacaggagcttgatcgggacgtctaaggtctttgcaaccgtcaccatcagtggggtgaaatagacaaaatagatgtcatagaagaacaaagatcccaggatcagcgatccggtgatgaaggtagacggcgacataaattgcagggtgccatagcagaaactgaatcccaggaagttggtcaaccaccatggtttggacacaaaagtgaagtaaccaattgtagggaatgatacagctatgctgataatgtccaagatactaagccagcattcagtgcggagaacacgatgtatatggattctaagcttagcgcgccaatatactatttcacggcaagtccagagtgctgcacgagcagtatgcggcaatgggattgacccccagaacccagggaggggagaattccggattcccacctccgaagactcccatctagaggcaccttcggaagcactttcaaagacacgttgggtggatctccgcttccaaatcttgccagagctgctgtactcgcgggggaagacgaatgagcgcacgacagcaaaagagtcttttaggaaggctatagcaaagagcatacccatctgggagaaatagtagccaagaatcttattcagcagatcagcgcccatgtgcttaatgaccagatacaagcccccgagggttaaaccagctgtcagtggaaacatcaatgcatcacttggtgcaaggccctccatcttctgaataccaccagcttcttcttcctcttctgattcgtctccatcttcctccgatttctcaggtttcgcggccgaagacggtcttgacagggatgcatgggcgccgatgtagatgggaaagagcgcagagacaagcagatgtccgtaggttggtaacaaaggtttgatctgtgtaaattggtagattgcctggcccaggagctcggcaatggggctgacctcgtccattgctgcgaagatctcaagttttgttgctagcgttggtgtgaagatgatgatgcaacaatggattagtccatggctcggtttcgcagacttcaaggataatatagtttcttgtgatggatgaggtcactggagggtcattcgggtgaatccgtcaagaagacggatgttgcagctgtgccagttagtagtgttggtgtgtttggcgatctgttgttgatggtgcctggtgccagtgacgtgagcgggtagatctgcacgtgatgatacggacagtcacgtggcatggtatagggaagacaattatctatggagtactcaactctcgaccgactgatatgaacctcaataacgcgcctgcagcggcagtcctaccttaagggttttggatgtgcgttgcccctgctatttcattgagcgctggcacggaggactaaaacgctgcggcagaccggtcatgttggctggaccgatccattttcaaatgtatcatgtaggggacgcacatcactggcatcagtggaccggaccagaacattgttaacgttcaatagttgtcccctcatccccgcaactgtttagactgatcctgcgtcaacctagataaggcatacttgcggcttgcgcccgacgcaatgatggtccgagcgacaaacagaagatggtttccgactatatataaagtacatctcacacatgtaattgactgtcgaatcagtactacgatgaacataactagtagtattagttccgggcagcgggctacttagatacagtaattgcattagaggggctagtgggacaagcattatttggtagtattattatctcattcagcatacctgatatcctttcctgtgctccgcttccagtggtaaagtagtattactcgtatatcctaaaccggcccacgaagtcgattctattcgagagagctcgatacaaactactatgccctattatgctatccagccgggccaggtccggtcgaagccgacagatttgaacatgtactaaagtacgctttcaaaaagaggtggtacctacaaaaggcgaatcagtggactgcatccgtctgcgagcgtcgccttcccaagaactgaggtcattaattgtgacccaaaaactggtttttcgaccatgtccacgctgcctgtccattgaatcgaagtgttcgatgtctcaccatgcagacgaactctctccctccctcgtcgacgaagccaattactggaaaagccgcagctgcatcgctgtcatagatgcatatgcgacatgcagaaaccattcgccgttttggtcaaattccctcgagtcagccgaacagcccatccctcgccggctcgttcccccaatctagtcgcactgcgtgcgaatttaactcaccgcaagggtagacgttctggcggggtggcgctgttgatggatacaaatacacctacctcctctcctcataatttcgttcagcaaccttacaagttccatttgcgtgtctcgcccgaagcataatccgtttattttaaatctcaacctccttgtctgacattgttagtccagaaacatggctcctttgcagaaagtggtcgtggtatacggtgccactggtgagtcaggtttgcagcgtcgtttgccgtgtatacatatctaacacactatcccaggtgtccagggaaggtccatctccctctctctcctcaagagccagcagaacttcgtcgtccgggcgcttacacggaaccctcagtcggaaaaggccaaagaattggctcgcctaggagctgaggtggttaaggctgatggattcaacgacaacgacatgcagaatgccctgtccggtgcctggggattctggcttaacacccaccaccatgacccagtaagtggccttcttgattacgagggcaccaactcctcattccatgaatcacacgctgatcgccaacatccaggcggtaacgcaacccggtgggccgactgacgaggatctcggcaaccgcctcatcgagattgcagccaaggcaggcgtgaaggtcttcatttacagtacctgcgagtctcctgcgatatttaccaaaggcgttgcacccgttccgggcatggatggtatgttcatcatgatttcttcgtgtccgcgtctaactttcctctttatagccaaacaccgatgtgagttgtatgcccgaacattcaaggagtttgacgccgtcattggcgccttccccgggtggtacttcgagaactatgtcactcccgagtacgcgcaggccttcggtggcttccccatgttccccgacaacgagggctacctgacctggcacgctcccttggtaggtggcgaaggcaaggtccaaacggtctccattgaggacgattttggtgagatggtgcacggaatgtttctgaacccactgaagtggaagaacaagaccattcagtgcgtgagtgatgcgttcacgtatgaggatatggtgaagaccttcactgagggtaggtttctaatttagctttctctgggagttgctaactgggtgtcgcagttacgggaaagaaatctcgctacattcccatggcctcagcggatgacttcccaacccatgggaactctgtcctcgttgagttgcaggatgtcttcaagtacacccagaataacaatggctggttcttcggtaaccccgacgacttcgcaacctgccagtcactcaaggacgaggcccgccgggataagggtcttgagccggagccggtcatctccatggctaagtactttatcaagcactatggacccaactagaccagaagaaccgcggagaagatgcagcgactgtttccacctgctaaggagacgtttatgtgtaacatgaaaactagcggataccttaccaaaccattctttccattctttctcggtgcacagttctagacataattacgaacgagcatagactatgggaaaactgcatcgtagtacacacactcgtttcccctgaacagtgggtaggaaacggagcggaaagcctagaagctcaggaaatggcgcactcgcatcccacgctcagtctgctgagttggccaggacaaatactccaaaagccaaatctgcgcagtgcgtaagtaatcctgcgtccgacgccgacaattggacaggaacattccggatgcatgacttgcaggaagggggtaaaaccatggcaagactgcagtgcctagactcgcacacaatagtcgactactatactgtgtagtagcataactaggtttaggcggtgtggcttttgttctgtttgtcggggtgacagcggtgactgagggcaaaatttcgggcggagatgaattattatcacaattcattcttgcgcttcacacttattcctcctgcggaaggcatttgacaatcattgcaagattgcatcattcagtcgctcctttgcattgcctgataatctttgaggattacttcaagaggcttatatcgggcccctgcagcttcaagggctcccaattccttgtcctctacccccaccaccattgtccgcggggttctgtcatagtcattcacaaaatcggaatcgcaaatcaccatggtgcatgccacgccagtcccgagcagtggcttccaagccttgatcctctgtggtcctggtgagagtctgaacactatctcctccaaccccgaagaaaatccaaaatgcttaatccctatcgctgtatgtattgccgaattctccgcgcagacccaagagcaagcagtcactaataccattggatacacagcttaggcctatggtatactacccgctggattggtgcaagcgcgcaggaataaatggtgagaaactgcaatgcgcccccttggggccgttgggtcttgcggtctttgcttgggagaaagactaacggctcagatatcgtcctgatcacacctccctccgctctggctcccctcaaggccgctctacaacagaacccctacctcacgtcactctcttcgccctcccccacgatcatcgccccgaaggacctcaagatgacgacaggaaccgcggaactactacgcctaccagaagtacaagcttgcatccaatccaatttcttgctcctgagttgcgatctgctgtgcgatatccctggcgagcatttgcttgaggcatggctcgcctcacagagtgaattgggccccgctgctcaaggaggcctgtctgtgttctatcccgcaaaaggcattcaagacgagatcaagaaagagcctacagattttgtggcaataacttctctcgaccaggatgaggtcccttctgtctcgcgtcacgagctttcaaagctggtcctgtcaatgcccatggataccttgaaagagcagatagagaatgataagggactcctactccgtcacaccctggtggagaagcatgcctcggtcaagatgctgaccagctaccgcgatgcgcacttgtacattctgcctaagtgggttcgatcgcttgcacagcaccaggagcgcttcgagtccgtaagtgaagacttgatcggctactgggcgaaagcggggtggcagcgtggactgagcgccaagctcggcattgatgagatcctgggcggacagaaggaggctcaagatgatcatggaagcaacgacggcgactctctggaggaggaaatcgatcttcgcagcatgaccaccacccacgctcagggttccgaggcccgcagcacgaaagctagtcaatcctccgtggaggtgccgcccatcctcgcatacacgaccaagtcgtccaagcaactcattcggcgcgtggacagtgccgccctggtgttggccatgtccctgcgtcttgccaagctcgagtcagttgaagaggtcggccgtgctgctgcctcaccatttagccatgccgcgaagattgctactccggaggcagtcgcgtcgaaatctattgtcacgaagggcgattgcttgctggggtctaatgtgacggtgagcatcgtgaactttattgattatgtatttcaacgctaacatcttgaaaaggtcgaggaaaagtgcgtcatcaaggagtcgtgtatttctgccaacgccaagatctgcagcggcgcgcgccttacgaggtaggcatcccatgctcctgccttatctacaccctaatctctaacataaaccaggtgtgtgatcatggacaacgcagtcatcggaccgaagtgtgtccttacaggatgtatcggtaagtcttctacaatgcacacaatttcaggtcatgaagtaaacttattgacaattttacagtcggaagatacagtcaggtcggaaaagagtccgtactcaaggtgcgtttgaaatctgctaagccatgtagataaacggcatgctaactacttttataggactgtgaaatccaagatggcgtcgtggttgaggaagaaaccgatgctaagaatgagcagttcatgagcttcgaaggactcgacgacgacgatgaggatggtatggatattgatggcgatggtgatagcggtgatgatgcggggttctagattagatggactgtatttcatataagtaaatacttatcagcatagtatatatgatcccactgcattattttgttcaatcaaagagacagagcttcgacgcgggctggtctgcaggtggatgtatgcatgttcatggttcgacctatacactaactactcgaagaggtgattcggattgacggaatgatatccagatagatataaatggatgatgtaatccggcaaagtaaataacatgcattcgcagtactggtctggatgcttaaccccagatactacatgtagtctttgacttgccttccatgacacttctattagactcttgattgagctttcccaatgataaacagacatatagatttattacaggtaccaagaaatacgatatcgctatcatgacctgcagcactaccactaccaccgcctatttacaactaatgttgggagaactcccaacggaccatgggactcaaatgaacagcagaacatctgtgcacccctgcataagagacaaacaaaatagcaaaccaaacaacaagaagggccggtagctcaggggtagagcgtgggactgcagatcttaaggtcacgcgttcaaatcgcgttcggccctttctttttcttttttctctttggatatctatccaattcacattggactgtgacaagctggaatatatgggtttgatccatggacatcttctctattttttttgtttttgttgtttttcttttcttttccaattctgtccattctctggattgtgttctgggttcctggtaccggagcggtaccactagtggtgcatagcggacttatatatccgagcggagcttttccgcaagtcgaattcaactttaatcattcaactatacttccaatcaatctatcacagggttcaattactatgatccaattagtatgtgaagccagatgtagtatgctcttcttttcgaactggagtggctagttctcaggttcgagctatccctgcgaccaccaatacccgacagagtgtagcaaccagaagcttatttactcgagatagaccgaggcgtacgagaaggagcagttactgaaatctacacaccggcgaacatcaaccgctactacttgggagagatcaaacatcgttgaagatatccataacattttatcattactagcagtgaacgcaccgcctccccactcaatgagcagcaacaacacccgcctcattagcctgagcggtaatcaacttcttataagcattgaccgtgccatcgaacttatgcaccgtaccctgatcacaaacccagagactggtgcacacattctgcagcatcgtgacatcgtgagagaccataaccacaccaccctcgaagttctgcagcgcctccgacagtgcatccataccctcaatatccagatggttggacggttcgtccagaaccaggatgtgcgggttcgtcaacgacaagcatgcaaacgcaacacgggacttctgacctccggacaagagctccatgcgctggagacccgtcatacctgtgataccgaaggctccgaggtgtctgcggtattcttcgtctgtctttccggggtaagccttggccatgaagctgacggcgctggtggtcaggtccagtgcatcgacgtgatgttgggcgaagaatccgatgcgaagtctggcgtgttgcgagagaagaccctttgtcggttggagttggccggtgaggagcttcaggacagtggtcttaccggcaccgttgggtccaacgataccgatacgtgaatcgagttgcacgtcgagtatccacgttgcggagaaggggtcggtcgggggtatatccgaaggcgatgtcggacatttggacgatggggggagagagcttctccacttcggggaacttgaagtgcacgacgtaatcgctctcgggggcttccaggacaggcatcctctccagcttcttgatacgggactgggcttcggaggacttggcggcgttgtagcggaacttgtcgatgaaggcttgcagatgggcgcgctcggccatctgtttttcgtattcgcgcttggcgttcttcttgcgctcttccttggtggcgtagaaagagtcgaagttggcgcccttgtagtagtcgagacgctcggagtgctggtggatgatgtcggtggcgacttcgttgaggaatgctcgatcgtgagaaacgaccaggatggtactggggtatgtctggaggtagttggagaggaaagtaatggacggcacgtccaacatgttggacggttcgtccagcaggaggagatcgggttcgcagaacagggctcgggcaagagccaatctcatacgccaacctccggagaaggtcttcgtcgcgaactgttgtctctcgggtgagaaaccgagaccagccagaatactggctgcgcgggactctgccttgtctgattccatctctgcgagtttggagtggatgtcgtttagtgtgatgtcgagaccctcgcgctcgtggtccaggcgagcggcatcctttgaggtgtctgccatggaggatctctctgcttcaatgtccgccagctgcttggtgatcttgtccaagtcggcaaggagacgcttgcgccatacgtcggcgtcgaggacagcctggagggcgggggtgtcgtctcctgtgatttcctgctcgacgtgaagaatggagatgtggctgggaatagccacttctctgcgactgagtgcacgcaacatcgtagactttccgataccgttctgaccgacgagaccgtagcgacgaccatacgccagggtaagggaggcgtctgtcaagatacggtgaccactgacggagatgtcgatgctgtccaccttgatgtccttgctcttggactgggagtccgaacccagctgcagagggttaaccgccatgaagaactcttcgtaagacatagtactatcgggctggttgagaagacgggatgattcgtattgcactgtcttcatctgtttcttctcctgcttggcacgaatcttgcgttccgccttctcgagcttcttgcggtctaccttagactccacctttctggcgttagccgactccagatcgacgttacctccggcaagacccagagtagaggacatattccgttgagagccgacattgatggcctggtcgagcttcttggcggcaaagggcatctggcgacgctcggcgtccacaccgtcagcagcactcagcgaggaaatgaatttctcaaccaagttgcggatggccttttcattctcgggggtgaagtcgcccgatgcggagacaaggagctcggtgaccatgtcggccgcttcggccagtggcgacggagcgttggcatcttccacataggccttggaggcatgggtcagataccccacggagtactctgataccacgcggtcaagaccggggatctgtgcttgaagttccgcctccattgtggacagtcaagcttggatcacactggattgagcggggggaaatggacccgaaatgggacacttgtcgcaggggatggacgtgaagggtgccaacgccgtgcagatacaggggtcgaaacaatgcagggatacaagcaacactagtccgtgtccactgcgatccagacgatatttaatcgtgcttctactgatatctaaatggatacccacgggcctccgtcatgtgttgtgccattagagttttcccgacgccggcgccccacggggcacgtgatcatggggtatatacattgattcactcttggtaaagggccagttcaatacactttgtgattttaatatgtattaatttgcagagccttgtatgaataaaaatgtctattcgggcgccataattccagactggaaacttagtaggggatggtcggcaagactctcccagaaaccaatctcaaaatctaaggattgctggtaaggaaaactggaccattcgattaggttcgggctgcggggtgtcatggctggcacagcgcgcatgggttcagaagtgactgaatctaggaagctctgaattgtttgcatggccttggacattagctcatagttgggttcctggggccgaatgatcgatccggcctggatctccgcagcgaggattgtcaggtgctgaagcgttctgggccgtgttatacgaggcatgcttggagtggccctctcgttgagcagagcaagtaggagaattcctgcggcggggagacaatgataggcgaccttcaacgattacagttaccttcagggctactagacatgggaagtacgaaatgagcacggagcttgacacataccttccacaagagacatgttcctgagtttgtaagttgatcacgcaggaggaccatgtccactgttaccgagaggatctggtcggcgatgtccacgagggtgggatcgggttcagtaggagcactgagcaggaggagattcagcaggaagagcgtgtgcaagtgattcaattgcactgagccgatgaagtcgcgttcgaaggtgctcagtgtactatccctgagattgttgcggaactgaaactgtcgaggcagtgaagagtaattcttttcagcctgtgcttttatgtcactgactccgttagttatacacaagaataggttatattgcaaagtaagcttacgcaacccgttgatagaaaagctccatgtcacttggccgacttctctgcaaattaagtatatcctctttgaccccggcacacaacgcagtccaccgagtttcagccatataactcgctttagtcgacgggttccagctgaaaggatcgtcgaattcattatcgggcttgtcagaggagataaaccagacgtcatcgggaagcggacttgatgggatctggaaatgacagaattgtctgttcatgcggggtggacgaccgacgaagatggcaacgttcctgtctgccgaatacacgcgggcaaagacagctttgcgtagctccgtcaagaagcgaggtgtatcgggcttctcatcgagattctcatggtagccgagagcatatatcgaggatataacatctccgagctttcgccacgaatagtagcctgggtgtgattagtgatgcatgaacgcggagcattcagatgggaaacctactatggtccccgtctacatgagaatgcacgataaagttttcgtactgcaagcagacttgaagatcattcagacagtcaagagatatggtgatttccagtgcatagtccgctaatctcgtgcatagctttcggaggctatacttcttctcttcggtcgtatacagcgacgggaaaaactggatatccatagtggctcggacaacagctgacaagaagattgcgagcgtttcccatcgcatgttctggttaatgaattgagcacagaactcgggaaaggtagagcgttgtgagtatctaagcggctgggaagagttgttgagaagggatttcgcatatagcagatgccagtcttcgtttgtcgatgagggtgggaggggaatgttgtcaacacattgatcaaccatagcccccatgatagcaagattcgtgccccttgcctgccacagcttgacaagctctttcatagcaggcaaggaaaacctcgtcagaagcattttgagggcatctgcacatcgctgaacgacaagatcatcgtcaggcgggaaaagagatgctgtccaagaagcggtgctaggactctgatgtgatgtagcactctgactatctgatgaagtgatatgcttaaagatagcaacatggcttgatgacccgagatatcctgggttgggatatctatttcctcctgcatgatgtggggatgatgctgtgggcgacgggtctggagagctaaatatggcggtacccaaagaagtggcagggtcttagccaatgtatactcaaacagaactaagaattagggacactatactggtgggaagatccattatctgtcactgcattgctggtctttcttcttttgaagggcgcacttctatagatgcaaagacccggtcggttgccatccctgcaccgattgcagaccggctgttggtggtcgcatgcaagctttgaccttctgcaaggctcacatgcagccaatctagttgccattatacaaacacagaagcaatggtgcaattactgcgttgacacgcttgagggtggaccggtgagtacggagaggcgtgggtagcgttgtcggactctcggagcggggtaaatggctatgccgagataagacaatttgcaccagtaccacttaatgttatactactcccagacagatgtaatgaattaagggctcaatgtggtctcgctcgagtgaatattctggtgactatgtaagcgggacccggggaaggacactgtgaacataaagtacgagtttctgggctagtaagcgctccataatacctggcaaatggcacacgcatattgaaacagtgttgtgagcgaccttcataccgaaattgttgccattatcatgggttgtagggtagcccttcttaacctcatattgacgaagtcctgagccttccagctcacacaaggaatgttgtgagttagacagactgaatgagcgcttaaagaggccccgaaaatataagacacgtgaaagcagatgtactatgctagtaattatggggaatgggaaagcatccttctgtcatgcgcggtgtatgatggataagctcttacataattactctaggcatgaaactaaaagctttagataccatttaagcccatatttataaacatgaagattacctatacagatccgcaaaagttaaggaaaggaaaaaggcgcgatacgcgaaagacaacgaggggcggagtattcggagtgatcgagtacatcactccgatctctccgatatcaagataaacgaagtctagctagctatcttgcccgaatctataagagaagaccatcgtttaagacgtcgtgaagaatatcttgaagattctcggcacttcagcccaacattcatcggtgataatggcacgtctgcaatccactgaaatcgaagcccttcgtgctgccgcgcctcctctccctctcacaattgccccttccgtctcctccgatctgtacaaatcgccctacacccgtgcaaaaccgcctgcaaaacgattcgacgaccatttcagcatcgaaagccggaacttttccggctcagctttgaaaaaggggtctagtccaagcggtccgcgcaagatcatatctctcgggacaggacgaccaactgcggattattatccctgggaatcaataaccctgggcgaggctcctccagtcccgacaatcaaaactacaacaaaacccaatctacacctacccaacaggcaggaaaatggccactctgcacacaccattgccaaaaacggtgcaacatacaacctctcaatcgcattaaactactgccttgcaaacggatcagcacacttactccgtttcatcaccgagcatgttgagctcgttcacaatcccccgtatgcagattgggcgacgttcctctcctgtggtgcaactgccgcgacggaggcggcgtttcgcattttctgtgatcgtggagacactgttgtagcggagcagtatacgtacccggggacgctggaaagtgccgatttgaatggggttagggtttatgggattgagatggatgcgaatggcttgcgacctgatgtcttggatgaggtactctcttcctggaatgatgctcaatctcccaaaccacgcgtgctgtataccatccctacgggtcagaacccgacaggggctagccaacacctggaaagacgcagagcaatctatgaggttgcagaaaaacacgacctcataatcattgaggatgacccatactatttcctgaggatgggcccttactatgatcacgaccaagatgccaatggctctgcatctgcagatgacaaagccgctcggatattccatactgagtccattccctcctacctcactttagatacagccgggcgcgtggtacgtattgattccgcatccaagattctcgctcccggattacgcgccggctgggtcactgcatccaggcaaatcatcgacaagttcactgcataccaggaagtgagcactttagcagttagcggcccctcccagctcatgctctggcatctgctcgatgagaactggggacatgacggattcaccgcgtggcttgttgatctctcgcgtgagtatcggtggcggcgggatgtcctccttggtgcttgtaattactacttgcccaggaagatcgtgcagtggaatgcaccggagttcggcatgtttttgtgggttaagattgactggagacagcatcctcagcttgagagctcgtccgaattgtcgctggaggaggttggtgcgcagataattgggctggaggagaagattgcagctaaggctttggagaaggctgtgcttgtaactaagggttcgctgttcgcttcgaataaagagctaaatggccatctgcattttcgtatgacgtttgcggctgcggaggagggcgatctgaaagagggggtgagattgtttgctgaggctgtgagtgaggagttcggactatgaatccgagtaaatgaacgttgggagatgcattgatgttgctggagcagatgagattattgccaaatgcatttcaaatatcaaaacaaatcggccaatattggtgcttgccacgcattaccctaatggcttgggtgtcttccgggggtcctgtcaggggctttaggccccatgtcatccttgacactgaaggagttaagtagtagctaatagtagcagggttagggatgaccgtgatggccctattataagaaaggaatatacgaatttggagagaagcaagtagaatgttggtcaagaagctagctgaacgcggcaagactgtctgtccactgtatggttgatgcgttctagtggtatcattcagagcatgcacaatagtactactacccagaaatttccgatttctctgagatccttacaatgaaaagcaaagttctcgccattcgtagtgtcatgaatgtcgtatcaatcgtaaaggtatcggcctttcccaacccgaaaggaaaaaagcagatttgcataaagtggcaaaccggagcgaagaggcaagcagacataaaacagcatcaagtcgtgatgtgacatggagtggacagaaagctgctccaattgttgtctgacctcgacaacagcccgagaaagatcgagttctttcggcaggctaccaaaactgaggatctttggaacccaacgacgggagagtatactcatccaagccagtaagatcttccgggaattccggtgcctgaatcttgctttttgctccagacacgtcacactcaataatgaggttcgtttcaccgggaacattcttcgctccgatatatgtgcgtctcataaagcccattagcgacgtcagcgcttttacttgcgtttcctcggaagcctgctgggtgtggcggagtaactccgcaaacaatgcaggcatataataaagaattacagcttgttcatcttccagaccgctctgattaagctctttgataagttcagctctatgatcatcggggagtccgagaagggccttgcggaagcgctctgccaagtcgatatctgctaccctgcccattgcatacaggcgcaagagggcccgctctttatcatcatctgtggataactttggatatcccttctcagataggatacggcctcggttttgcaggacctgattgtacgcttcctgaatcgtaatcttttttgaaacaacgcgcttcaggattttgtaagtaagtaggaatgattgacagaccggctcaatcatccggactgaaccgcaggcatcaacatgcgcccctgcaccagccacgtcgaacatgatctcaagatacttcaactcaaaggcactttcctggcctcgaagatcttgaagacattgaaggcttcctggaacgttctcaccttgggctagctgcgggatattgagcttggctcccagcctcactcctcgaagcacatcacgtcgaggagccggcagaagatccaacggagtatcaatgattcttaattcaagagccttttcgaggattgtatcatggttcatgtccttgtctgatacagtctggagtcgggcttgcacctctttagctagcccatggtctttacccacgtcacccagaaccagagctacaatcagggccatcagccaatccggcttttttcggatatggttcgccaattcgcgaaagtcattgaatgttgcgctctttaacctcatggattccttctgatggcaagtgaaggtgctgtaatcattatcgagcagccatcgcaccgcaagaacattagtcaaggttcgattcacctctgagtaatcttcgtcgaaaagatatcgagagggagtgagattatctttatctgctttcccctcaacgcctgtccgggttagcaagccttggggatgcgtatcgtccccctcgatgttttgttccacattcttgagtctttcgatgacagattcaaattgataatatacaagctcaacaagctgttcgtcactaagcgattcgaacttttccttgtcgatgacttgtttcagtgatgtataggaagccatgttcgtgctgcaaaggttgcgaagcctgacgaggaggcgcgctaggaatggtaatggcgatgaaaattgtgagattctattatggcggggaggccgcacagtttgctgaggtgacgttcgtgttggcattgtggatgggagtggaacgcgccccaattaaatagtaggtcctgccgtctccctcgcaggatgtcctccactcttatacggtgccgcccgtgcaccgcctcacccacgctaggagagttcctccctgactgggacagttgtttaatgtcttggaggcttccgtgcagttcttagctgctcctcgctaggtaactgctttgtatgtggtggaattttctttttctcaaactcggtatctccctagcgcatgattatggatcgaattcgcggtgggtatatggtcatggggccctggcggtaactggccgcatgataggaaccaaccgactgatttaattagttactttagatcggtcttagcagtagatctggtgggaaaacgctgccaggaacaactgacttgatgttcgatctccgccgacccacatccacaagcgtgaggctgggatatgttcagcacgaggcacgaggatgagccgggttgaaacaaaccaggagggagactaaaaagcaaagaaccgtctgtctgttcaggagtccagctgacgagacgagccgcatcacccgatacccgattgggactgcaatactcagggctgaagctgggcgcatctttagtaggagtgcagagtccagagtaaccagttagtaggtaaataattcccccgattactttagtagtctgtagcgatctacccacggagtactccatcgactataatggcaatgagcgatctgtcagaatccttcagacagatggccaaatacgtgtcactgcatctgcgatcaacgagaagcatggtgagccagacaaggatgtgtcgctttggtatttgtccaccttgggtcttcttgctgcgcctcatgttttcggaacacctggatatagtcggcacgtgccatcgcgaatctagactgcctcttattgaattacctgctcacgggaccacaaaaatataagcaatggaattacccctcttaccatcttaccttgtacaatctcctgtcaacctctcaatcttagtaaggtaggatggtatttattcccgtgacaaggaattctagtcatccactattgcaagacccttagatgttgtaaacaaaattgacatcacattcgctctaaaagcttgattcttttatctcgctatttatacatcaagagtcatttttttaacaaccctttacagcctcttcaggacatcatccaaaacctcctgggtagtagccttaccgcccatgtcaggagaaaggaacttggcctcatcaaggttggcatcaacagcagtgtagatcttggcagcggcagtctcctcacccaagaactccagcatcagggcaacactgcgcagagtggcgatggggttggcaatacccttgccctcaatgtcgggggcactgccgtggcagggctcaccgatggcgaagccatcaccaacgttagcgctaggaaccagtcccagactaccaaccagggcagcagcaccatccgacaggatatcaccgtacaagttgggggcgacaatgacgtcgtagtattcgggctgacggaagagcttgtaaaccatggagtcgacgatctgctcctcaacctggacagaggagaagcggtcggcggaaagggccttacgggcggtctcacggaagagaccgtcggtctgagagagaacgttggacttgtgggtgatggtcaccatgggttcggtgcggaggccagcgataccagcaacgctgcggatcttctggcgacggagggcaatttcaccggcaatggtggagatgcgggaggaagcgttctcggagatacgcttgatagcctcggcaaccttgccattgggggtctccttggtctgctcttccttgacgtagagatcctcggtgttctcacgaacaatcaccaggtcaatgggcttgccgtcggtgctgccggcggtggtcttgacggggcggacgttggcgtacaggtcaagcttcttacggagggcgacgatgggagaggagtagccggcgaccttggtgctaggggagctacagagattagttaggagggaattcagtgacagacaaggacaggagatatcgatgtagcactcacctgacagcgccgaacagagcaccatcgcactccttcttgaggatctcgactgtcttatcggggagagcgctaccggtgcgcttgaaggtgtcgaagcccgcatcgagatcgacgaagctgaacttgaggttcagagaggaggggagagactccaaaaccttccggccggcctgatgaagagcgtttcgttagaattggtgtttcgacaggaagctatttgctggtggtgactcaccggaatgacctctcggccgatgccgtcaccggggatgagacctgcacgagagaagatgtcagcaactagacgggcaggagaagaacgttaagagatggagaggagcaattgacctatgcgaagcgtcctagcagcagcagccattgtgaataccgtgcaaaaggggatgcaagaaagagagttcctgctggctggagaaaaacatccgcttaacggacgccgtgatcggaggattcccgctagtttagccccatccgcggggatgcacgtgatgggcactgaccacatatgcgcacctggcgggtatggctttccgtaatatagtatatcggaggtgtcctcggagtaggatactgctattcatcatatgctatatagctctttagcgtcaagtcttggctttctcttactaagaccactgtgaatattgtgataatatccgatatttggtgttgtactcggaaccgcattactatgacctacaagcacagatacaagtgttcttggcacagcatatcacggccctccttcggaggacgaggtgtgcattgagtatagagccgttgggacaggccggagactagttgatgtattttgtgactgcacgagaatctcatattttgccagaaacggttactctggatgtgcttttcagcttcggacttggacggccagaggtcgggacgggtgctggtctagagggctgggacatttgctttggatcatgggctcaaggaaggtgaggatgtggaagagagggacacggaatggtgtgctctcgacggctcagaagcgagaggcgcttattattgcagctttgacaagccattgaagtcatgccagcctacttttggtattttcatatagattttctagcggcgtgcacaaaatgatgattattccgtgtggtaactgaagatggtctgcaagagttagtccgagtggagggcctcaatatcgttgcttggtcttagacccttttatgcttgaagatagctggactctgggatacaccggttggtgatatatgatattcattaccagggctcaatgaacggcttagtcctctactgaagtagaaaaattgctggcaataataaatgtagctcatctccattaactactgcatattagacctggtaaatggctacttaaattccaaagaaatcatcatgtcattgtaacgagaggaactggtttggatcagcggagtgtaaagctcgttgctccgtaaaacgagcaaagtcgtttacttgaattgatcgatcatcccctagcgccttctaggagctgcgaatcgggtgtagccacatagtgtccatcttttgccgccatatatcattgttagcatgctgctgcctagaacttggggagcatgatgtgatctagaatgtataacttactgggtgaataagattggctggctatgattcgaaatagggatgttgtttcatccacccttctagttggcgttggcagctttgatactattggcggcgttggcggcgttggcggcctcgatgctgtcaatgctgtcgatgctatctgcagcattgatactacccgcagcattgatactattagcagcgttggcggcctcaatgctgtcaatgctgtcgatgctatccgcagcatcaatactatccgcagcattgatactgcgagcactattgatgctgccaatgctgtcaatgctatctgcagcatcgatactgtgggcaccatttatgctgtcgatactctcgatactcctgccattgatgctgttgatgctgtcgatgctatccgcagcatcaatgctgccgatgctcttggcgccattgatgctgttcgcagcgtctgtgccaccggtaaaatgctcttctctcttgtgcatgggccctgccagtccgagcccggcgaggaggggcacaagggcaatggaaaccttcatattggcggtatgggagctagaagatgtggatgactgttggagaaggagtgaagtgatgtagtagaatgagagatgataagatggcgagttgagcttggtgaatgctctctttacccccgggacagttgagcctttttataacccatgacaatggtgaggtagtagtatgtaatctgtagttaatggacctcctgtagtttgcagatcctcgctgggctacgcaaggctggtattgatcaccatgttagtgtgacgggtcccccctctgtctcttctagataggttatcaagtaacgagtggtagcgtttttacgggtgcaagtctatggtgtagctactttaggcatcaagacaggaatacatctaagggaatttgctgatcattatctgctgaagtaaaagcagggggtaaggttacacaagcataccgattttttttttaatgacgtgatgtgatgcgataccatcaactgccagcgctcaagccaatatattgcctttgtaaccccgcgggaagatctccgtgaatttacgcaattcaatgctcctgggattatactcaagggatggaccgggcttgtttgcttggatgcttagacatgcaagtctttgttatgcaattggttggtaagagatgtatcctatgttctcaattggctaccagctatcatttatgcatagctctcgctacacgtaatgcaaggtgcacgcaagccaccacccgtctttgtagcaccggatacagagtgacgtggaaatccggcagtatgcatgacaggggaaggggagtgtcgtgtctgaactctagcaatgagcaatgttggacgcagtatgagtagcagaccccaacttccaatcatggtggccaacaagaagccttgcagaaaggatagagtcagttccagtacatcgattactacgaattctgaagaattcagtctagaataagtagaagatacccgcccaaactggtataccctgtagcgggttgcccaagaggccatgctctagtttcaagggagatttaagccgtctaatatgtcactaattatttatatcatgacttagcatgctcaactagatagtttgacgaccgaccggtcagcctaaattggcattaggtagtactagtacttagtcgtaaacatcagcgaagctactagtagcatccatcctagtatctacccgctgccaggggccagagatatccctcccactgtccgtccgatgaccaaatggatagatttgctgcgatagtatcaaacacaccgctacctcttccgcataatagccagcatctcaaactccatcatccccacctcaccagggatagacacgtctgagaacgacgaattgcgaaagcatggctcataatcggcccaatccgcccgaggccccaaccaaagtatcatctgcaccgatgactcagatccattctcatcatcagcgtacatttcaatatacttgctaaccagcttcggttcacgcgggtaaacaaacatccatgctgccgcctgcggcgcacgcgcatacagatcccaagttccgctgaccacgtcgaagttctcttctgcaaggtagcggttgactgacgcggagacttctatcccggtgatttggaggttaggatggttatgcagtattagggcttccaggagaccggatccacatcctattgacagggtgaatgcgggcattttagggaggagccatgctaggtgggcgattagggtgctggagatggataaacagcagtttgggaagggggttggtgtttcagtgaggtgtgggatgtccattgagttttctttctcttttctttttctatttttctcttctttcctggtgtctcttgattctcctatgttatattctttttttcccccttgagatgcgtggtatatcccgtatactgtaattgtaacgacgggagaggggaaagaagaagcggtggaagttggaaaacggcatggatgaatgaagcttttcgtttgggagaggatcatcggcccggatttactttgaacatgatgtttgccagtcggcctatcaggtcctatggaaatgccccgcggaacttataagtgggtactggggtgaggtgggctggcagcatcgcatccaaagaaacccctggcatgttcagcagtaaggcactatggatcggagcatcagatttcctgtcaaagtcgctcggtgacattgcttgtttgtgcacggggcagaagccccactcccttgatagacaacccatgaggaaagaacttcctcgttctcgtgtgtcgcgacttctcatgctagggctaaagcaggagtaggataccactgcgatattagatctagtatacggtgattgttactcctagtagcttctaactcactgtttagtcctttctgtctctctcaggcccttaccaacgaccccaccaaccccaccataagagtgaatgcgaacacccaacgtgctacgcagttaagggatgcaagtaaccgtataatgttccggcctgtcatcattgattctcataagaccgcagatgatcttgttgggagttccaaatccctatccccactcctactctcgccgatgctcgcgctctgagaagatatgattaagtcgctctgttcccgtgtctggaacatcatcatgtcttcggttaagttgcaattggagtgggagaacggccactcttttaggctcaggctatcaaggtaattttgaagcgtctggattagataagctagattgtatttagaagaagtagaatgatagtgttaacacagcactattgacagataataacgggactatcttctaaagccatggccttcccagtactccccaagtccaatccatcgtgagagacataagatgtacgttgtccttattgtattcgaaagacgaccaaaaattcttcctatccattaaacgccacaaacccgccacattccttgggtataaccaaaccagaccaataaacaccgaccagatcatgcgtgaacgaatataaaacagtgataacaacttcaacgagagaaggggcacgggagtactaaacctccgctacccattaatggtatccccgaccgcagacgagcaccaccatcgaagtaagatcttccagtctgggatgttctgttcccagaatgcaaagcgtttcgattgacggatcaccaggttggtgccatcatgatggcccaggagaatgcgagcatgtcttggacccacgaaggaaattagtagcaccttttgggtgagttagccacaggaattcgaatgagacggaaagaagacatgacatcactcaccggactgacttggtgggcacgatactttctggaacagaggcaagtgttcatgattcgacacatacataagatctccccacgggtgatctgatcatcgtccgcgttcacactctcgagtagatagcatttcatccgaggcccacccggaataccggttataccacccacgcaccagtcgaaggggttctcaatatcaagctcgcagagggaacatggaaactcaatgggcctggagacaaatcagtcatttgtacgtcttaatattggttctgtgctgtggacggaaatcgatcatactgtctaggattatgttgccaatcaaccttgtggataagtgtggcatctgtgatataatgcccgaaatagtagctcaggatgtgtgcctcgtccatcggatctaaggcttccttcgggctggagggcgaaaactctatctcctcatcagggcctgggaggggcttctggtagggccagaaaaattcagagtcgaataatgggtccccctcggcggacaggggcatggggaggatctgaatggggaggtgatccaagtctttgtgctggtatcgattttccggacgattcgagatggtttgcgcgacggccttgatggcatgtcgccgagcttggtgttcgttactttctggcatcttagcaaaatagagaaagccgagagtggatggtaggtgaggtggaagaagggggcagttggagggtggaaagagaggaggagagggatgccgattagataaagagcggttccggggcaaccacactctttttaccgcccgcgatgattagatggggggttccagacttcttatccagaccccaacagagacgcacggacagcttcttcccctcttcgcgatccattccaatccattcactggcgggtatccatccataatgattgactgacgcccctccactttcactagattccgtaggaccttcactggccaacaacacagctagtagtagtgaaagccgccagccttgatggctcctctttaaatagcaactctcatggactagcaggccccgtaggcgccttacttctcctcatccctccactacctcctctcctgaccaacgctactctgctttaagattgtagtcattggcatagttcatatgatccactactttactctgtcttctgcagattgcctcttacgtgagtccattgttagcacagcgtattggccaagtaggctaaatacgatatatcgctagctactcggagcaaacggggcggcagctatctcagcattcattactatattgttcttaagaaaacgacccacagtgatttggagctgtattgaaagtcatgaataagctgcccggagatgtccccgcaacagccactaagtgggccgagttggcagagaaggagggtgttctcaacacacacatccacaaagaaacattgtcaagtgcttcgaagatcaaattgcgccagtatttgcttctgcgtgttcttcgcaaggattcgcacaggtctaagctgaatccccggcggcttggcctagaaccgtggatgagccaggctaaggagatgctgcagtcttatccctcctggaacatctatcgcgagagctttaggggcaagcttgaggaggggaacttcttcttagttaagaattcacagattgaggcagcaaaggtcaaaagcaacgaaatttccaacaatgtcatgttctccccggtttcgaagcacacgcgccaaagcacccgcgaacgacgcgaaaagcccaactcgacaccgactagatcgaacctaccttcgcttgagcagctcagtatctttgatgaagctaccgcaacaggaccagtaaccccaggaaccgagggtaacgacgatgacttccccgaaccggcgtccatttccacgggaggctctctggggcccgaggagctcctacgcgaaatgtaccccccagtcgatgatgaacaaattgtaaatgttgctcttgtgagctttcttcaagctctcacggactatttcccttcgcttggaagctcttggaccatccaccggaagccgctcaaagccaagttcaacgatgcagagtatgaggcaaggacggacggatatcttcgaggaaaggtcgatggggaggttcgtgcgttgatcgaagtgaaagcagccctccgggaacattcccggcttgagatccgtatgcaggagggtgcccagatggtcgcttggcttaagagttatccccaatcaccaggaaagtttccgtttcggtaagcaggccgttcagaatgttttattgtgcttttaaaatgactcggaatcccaggcgttttcacgtctcgcaagatagacatcaaatttggctaagctttgccgaatatgacgatgagtacatcaggtacattgtgcatggtttacaagatccagaacgccctcgatcatttctgacgatgcacgaatttggtccctacaatactctcaaagagtcacatatgactgaacttgcagttatcctccttgcgctcactctgcgtgctgatcacgatcgcaaagtagagcaggagagcaatccattcgataactaagagttaggttaagcatagcccggggagaaaacttgcaagacccctgagtctttgttggcttcatctcattcgtcattcagtcgaatggagtttgtatgagcctctgttattcttcattgagggagaaccccattctttcttctgtgtctcttttctctctcttttcgaacaatcttcaagtaaggtacgggggttcctcattcataaaagcgcatctcaagatggcctttgaatgtctggtgctaattgagactatatgtgtgtgtgcaaagctcggatttgacgaagcaggggaaggggcggtgccttgaaacaccggcaaacaaacggttatgttgatccttccacctagaaatatctagagtttggcctaattgagcaaattatgcatgaaaatacttttgtgtctgggtatcagctgctgatatactcatagtattaaggctagtataacaatgtaagcttctggaagcatataaaagtttgactttctaggtacgagaattctagagatatcacagcatcctacatggtgcgtgacaagggggataatatcatgtctaactatgcctaagccccagtgaaaggccccacggggtaaggaagggaggagacacatggggagtgcctccccttcggtggatggcgcaaagtgaacataatgataattatgataatagcacgaaacttctaaggacagtagggataattgaatgatacggaattgttcgagaagtagctaaatggcttaatgatcatgctgatcaatgatgagagtggtgtcagtgttatcccacaatgttcatagtgaatagtactttagcacagacaagtcaaatggtggcttgcgcaagccttgcataaggcggggaaatgctgaacaagaatgatagataagggttgggtggtggccatagcgacgagtaggtggagccccgataaagaccagttctaatcatctcctttgaagagacaggctagataaaataacatctagcatatagttcgaatgtatttgcttttatcgcaggaaatttgtatgttactattaatgagaatgaaaacttttgtgagatccaggctggtattctctgtgtagggtattttcagtatatcgtggctcgcaaatacattgatttgtctgagcgtctgcttccaattgttgactaggtcattctcatacaagagacatgctgtgtcactactggtagtacttgatgcttccaatatgctgtgaaccacatccctatgaatctacatttacctaaacaagtgcgttatctcaaaaactgatttgatctggtggagcttatgggatcatgctgtctcttctcaccacctagttcaaccggaagagggagagagagtaacaacgcgtcgcacgacttgagcggtcaatgaatttccttgcatgttgaaggaaagtgctcagaagagtcggaattgttctctctttttatttatcccaagtaatccttgcctcgcctttagacataaaaaggctacattaccccggctattgctagtcgacaccaacacaatcaaacacatcctctccatccaccatcaacttcaatactcaaccatctccttgttcgtccgtctatccattagtcacttcctgtgaatcataaccctgcccatcatgaagttctccatggtccttgtgcccatcctcgctggattcggcctggcgggtgtggtgcgtcagagagaagaatctgctgcaaacgcggccgacgttgcggatgccgctaatgccgctaatgccgctaatgctgccaatgctgccaatgctgcggacagtgtcaacgcagccgatgttacaaacagtatcgaggctgctactgatgcggaagtatgctgcaacacaactccctgtttcattggatgcccagtcaatggagtgtttgtggtaagtttccttctatattccaaatgaccagggattattactatcagcaatcatgctaatgtagctggcaacgctagctctgctgttagaaggcgcggcttcacaggaagggcgaggtaccaagggacggataagtgcaaattgatagcttcggtcgttgtatggagttctctattgttaatggagtttaagctcggccggccagaagcgggttccactcgttttgctactcttctatttgtctacttgagttcctattagttcagatctagcactccaagaaataactgtcaacccacatgttttatggtgaataaagcaccttttccattacagataggagaatgtaactgtcacaaagggagacctagaaaaagagaatgaggccaaccccggcggtgatcaacccacgatgatatgccaggcttggttgggatcagccctaaggccgatccccggatcagcaaggagccctagacagaaacacatacataaatgaggatcataccctacattcctatttacggctgggggttaggctagttttccgatacgatacagctcggtcaatatgcataggcacggcatatatcaatcgcttgtggcgtagctgagctatcctacctaccctgtaggttcaacccatcgagaacgggaaacaccaaccttcattcttctgcatgcacacacctcgccttgaacaatgcatgtatgccatacccgatttgatattttgaaagatggcttgtcttctgctccgtactatccgacgtcacacctcatgcctgtgggccaggtagggtcgagtagattactctcagactggaacactttaagaataattcaaaagagtatacagatacatacgaccacagggtgtgtcgcccaatggcctctgcgggccgagcaacaacgactgggcctgcttcaattccaggtttggggattgttgcgatacatacggatactggtaaaagcacccgactggacttagagcatctttcatttcaatctgactttcgtctgtagcggttcaactgatgattattgtggcgccaactgtgattccaactacggtccttgctccgggacaatttcgaccaacgggctctgcggcgccgataatggaggttatacatgctttggctcccagttcggatcgtgttgcagtacctatgggtactggtaagtaaatagccgggtgttagaccattttatgcaggctaaccaagttgacagtggatctaccgacgagtattgcgcatcggccgtctgcgatagttcttacggcgggtgtagatagttgagggatcacaaattagcagatagtacggagtacggaggctgggtacacagtaacatagacagattgagtgggggctaggacccacaataaaatccgtagttactagaataacggaagggtcttgtaatgtttcttaacctgactattttcaattagtacgtactacagtagtttgccaatgggaatattttgcgcacccttttacttttctcatgaaactcacctaaacccagtggactggcgatatattttctgtctttttctcttctcttctcgctctcgaggacttggaactcatttaatcttcataaccagagctcaaagtcaaaatgtcaccgcccacatcagaagcgtcttggccggcaggcataccggagatccgccagcatccgacggacttatcccaggaagagctcagggaagaggccaagggatggttgctatttgtacgggtaaggaagagtctgtggaaatgcacacttcacttgtttgatgatatttcgtgtgtgacggtgcagataacaggaaaatattcagcccacatcgactcctgaagatgggctgcgtcaacggcgagcgctaatagagcaatgggccaccgccagtcaagagttccgcgaggcccgtactctcttcctcttatctctcgtggctgtatgattgactataatcttcgcagacctaccatagtcattccgcaggatacagctcggctttcgactaccccgcctcggttctttcgcagatcaccccgcgacccaacaaacgcttcttgtgccttccctccgtggaccggcagacccatccgcgtaactatatccacctcgtgaagttcctgattttgttgtatatccaccaagacgaatggaacggggtgcaccccttcgaagagcatggagcaggcaccgctcctaactaccaccttccggacctccttgactgcgggcccaccacgccaatcaccacctttgacgagattctcccctcgctgtatctcactccagcggatttccacgccatctccatgacccgccagggcacggtggtgttcgccaacgggccgaacctcacgtggttcgtgatcgatgcgccgggacttgccacagggcgactggccctggtggactttagctcaaatggccacgtccgcgtctcgacccttcgtcgaccctggaatatgggccaaaccatggccttcgagcaaattctgggtagatatcttggcgagatcgttgagtcatgcattggaggcccgccgcagtataacgaagtgtacgtccatattctctctctctctctctctctctctctctctctctctctctccttctcctttttcttttttctttttttttttttttttttttttttttttttgtggctcagatatctattcctctaatgtcattccttctaaaataatagtttggatatggatcttcctattcttgaaattttggagtcaacccggttgaataacaagttcctctgctcgggctacggatctcgggacctctggatccgccttatcaacgagagtgcgccgggatatctggagctggaggcccaaggacgggaggtggagtttgagctagataaattgctggttatcgatctttgatgctttttgcaagctcgctcgtgtttgataggttttcggtctaagaggatacagggtcacggtttgttaatatatcgcctagtgtccatcgactgaaaaagtcatccgggttgttttctccttccacatgctttaggttgggcagctatgcatgaattagtgagcgcatctcatactctgatatgtcctcgttgacttcattgcccgtagcgatgagccgctctttaactgccttggtacgtggttgtaattcggcacgcgagtctgtgtaaatcaaaacatcatcaatgtaccagaatgcgtaatataagattgtggagagggtgtgatccgtgtaacactagaacacagctactccaggtttgctctgccttcaatgaggatagtggatggtatgtaacaggcgaaggatggcagcgttacttttaacatcatatggtttatgaatcaagcttctgcgagagtgctagtatgtctataaacatgcctgtatttgcatagtaatggttacaatgaatcaatactgggattggaggctgtgtggagacatgcaggcagatacgatctgcagcgaaggtggtaagtgacaccttgcatgcgtgtggagtgaaggggtcggagttggtggaatgcggggaggggtgagcttttgtgaagaaaattaggggcgatgaggtgaaggaaggcatcaggaatttcgatgtagtagttgatgggagggagtggatcatcaaactagtaccagtactactatggactcgcagtggttttggtttggaatagatgggtctgttgatcgtcgtggttggatctgctgcagatgagcagaatatatacagatgatctccctaatctctatatctcttcaattacatcattcatcatatctcatgtcatcctcaatgcatcccagcaacgccccagctccccctcttacaagcgattcttcaacggcgtctcaaatccatctgcgcccgtatcctcccgatgcaacttgctcccccgtggatcaaacaacggatccgccgacaccgttgccttaacttgcctcccaaaatactcaatcacaactgcatccccctcacgaaccctcccgggcagccacgcatacgcagcgggcctctttgttgtatagctaaacaccgcagtagtgacatacccgacgggcttcccaccgaaatagacgggttcctttcccattaccatagaatgtccatcatcaatagtcaaacaccgcagccttctcaaagggggttgcttccgctgcgcagcactctgaagcgcggccttacccacatactcctccttcttgtccaaatcaactagatgaaaaactcccgcttcgagcggatcatgctccgtcgtcatatccactccgtatgtccgaatccctttctccagccgcagggcgttcatagcgctacggcccgcggcgataagcccgtgcggtttaccagcctgccagagcgcatcccatagacgggaaccatattcggcactggtttggacttcccagccgagttcaccgacgtaggatttgcggagcgcggtaatggggatcccggctatcgtggcacgtttgacggacatgtagggtagagcggtggtggagaagtcgtcgttggaaacggcgcggataacggcccgtgagcgagggccccagaggccgatacagcaggtgctgccggtgatgtcggatacctggacccattgggccggggtgtgttgtctctggcgacgtgcttcgacggctaagtaggcgacgtcggttgcggtgttggcgccgatttggaagaggtcgggttccagacgagcgacgaagatgtcgctgcggattttgccctgtctgttgaggaggagggtgtgtgtgatggcgccgggaggagcggtgatgtcgcttgtggtgaggcgctgcaggagggtggctgcgccgggtccggatacttgtacgcggtggaaggaggttaggtcgtacatggcgacggcattgcgggtcttccatgcttccacggcagtgatcggggaggtgtatcgcgatgaccaggtgtctcggggaggtggttgccattgtgctgggagggcgtggaggagctgtgcgtttgcttcgtaccagaatgggcgctcccagccgccgagttcgaggaagaaggcgcccagtgctcgttgtttctcgtagaaggggcttacccggagctggcggggagattctctcggttggaggggatggaggatgtcgtagatctctacgaagttctgttgcgaggtctcgttgacgtagtcccggctcagctgtacttcctcgaagcgagatagttcgcactccgtgagatcgatggtggatgccccgtctgtgagcagctccgccatgcttcgcgcgactccggcggagtgggtgacccagacggcttctgctacatagaatccgtcgaggttagaggcttgtccaacgaggggccccccgtctggggtgaacgagaagatgccgttgaatccgtcctccaaatgggtctcgcggagaacaggtagcagttcctgcgaggccttccaggcgggcgcaaagtcctgggccgtgaactcgagtcgagagggcatgtgcttctcgtcaacgtgctccggagtctgccccaaggacgcagccaccaccggcataggacggtgtccatagtatccaatccccacctgatctccatgctcccggtagtatagatcctgatcctgatgccgcaagatgggcatactcgcattcattccgttcggacggtgattgacgtcgcgattcgctagagcgggcacggtggtcgtcttcgcatactgatgggcaagtggtagaagagggatggcgaccccagccatggctccgatttcgacgccccaaaagccggcgcaggagatgacgatatcggccggaatgataccctgggaggtttttacgcccgtcacacgagatcctgtttgttcaatgcctgtaacaagcgtcgagcctcggtaacggaccccggcctgctgggtccgggcgataagcagctgggttgcgcgggcagctaacgcgagaccatcggtcggagtgtgaagaccagctagcacgagatccttgttcagaagaggatacttctccaaacactcttccttggttagaagacgcgcatcaacaccccaggacctcgcatagccgagcttgcgcttgagctcttcgactcgggccggcgtcgtggccacctcgagacctcctatcgaattgaagcacggcatgccattctcatcacttagcgatcggagtttgtcaacggtatattgtgcgagacgagtcattgtcttcgaaccgttggtttggaagaccagcccgggagcgtgcgaggttgagccacccggcaggttcaacgggccctgctcgacgacggtgatgtcctgccatccccgcgagaccagttcatcagcaaggttggcgcccacgattccagctcctatgatgaccacacgttgtgttgctgccatctttcgtcgttttgtgaaatgatgttcatctgctgattcgacaggataatctgccctacatattgtgagcagtccctggcgaaaggtccagctattagtgacagctggtgagggcagcagccggccagattggccggtccagcaccggcaaggattccgtggccgagccgatcatggatgatggatactcgaaaagggcaacgcaaccgttgaggtgcaggaatgataagacaggccagcagatcggatggaaggcggggatcgggccagggaaccgtctccacccggattctcatgcactgatgctgcttgggccatggaaacattgccctaaaggggcaaggcggtgctaagctggcctggaagcttgggccacgtcctgtgcattccctcgcatttggaaagacaagtagatggtatccgtggtcatcatcgcatgacctgcaagctttccgaccgtggatgcgaggcggggatggaaccagatgcagctgtgcggggttaacatcaagacaatcaatgctgattactcgttgtgattattggttccgataagatattgttagttagtgcaacaaagagacagatatatgttgattacagctagatctccatgcacatcaacgtccccaaccacggcacattgttcgccctggtatgactccaatccccgacagcccggaacccttgctgttcatagtaccttttacagatatgttaacaccaacaacttaatctcttaaaaaaaagaagaagagatgataagaatagaacaaacctgatcaattttctctcatttcccgcccatccatccacccattgggccttcatccctcttccttgcgcatactccctcatgcccctgataagcgccgctccggccccgcgacagagccgacccacgcgactatccgtaatcataacctcaagatagagaaacccaccaatttcagtactactatggatgattggcatcggaaggtgatgttgtgatttcacatatttaggaacccaattctcgcgaacataggcaaaccctactggaaggaagcattgaccgtcggacgtaactcgcaggtgggatgaaagagaccctgtatgatcctcattatcgtggtggtattctctttcaacgatgaagatgcgtagaccgtccatgttgctcttgccagttaggcgatattcttcggattggtcgagttcttttagggtttcttggggaaagtctcctcgttgggagaagggagttgagccccattgttcgtggctgccgatggaggccaggagggggagggaagagtcgaaggcagacaggatgaaggcgtggtcggtgggagtgggtttggcggggcggaggtggaagggggagtttgaatgggtggtcatttcagatactattgttgatgcttgagacatagtgataaagatagtgatgctggggattggattgtaagttaggcttcatgtggcttgatgatgtgctacgttaatataaagggctgtgtgttatacccagttcattgttgttatcactacttccttatctggggagtagtagactaggcgctagtaatcattgtcactccagcgcacttctcttgactagtgccatattccctcttacgccattagcatcacaactaaacccacctatcaaattcccctaatcacccctgggagaaccccaatatatctccagtcccaccataatatcgccgtaaataaaaccacgtggtagaagaacagtcctagtgctacactaatccggtgaagtccggatttcacgaaatgcagtgtaagtatgttgtgttcgcatgggtaagcccaacaattagtgtagaatatgtagcgtgtgtggcaatcattatgaaatgctatgtctacactaaagtctttgtatgcggctacctcccatctattggacgggtctagggccaacactgctcgagtggcacgctgctcaaccactcatacgtaagacacaatccatttctccaatgctggatatctttttctcgttcccatctaaggttattcccggctttctgtgatgcagctacctaaacctgaatacttggcactccatagccaccgattcattacattttatctttcagagaagggttaactgggttacaaggctaagggtgagtaaggtctatttataactaccaagttcctgcagtactgaaactgacagcacgcatatccttccatctgaatctttgcagtatctccctccaaatattcctatttatcactacccatccatccaccatgagctcaaccccttgcacagcatgcagctggacccctgaacgccaaaaatactgcagctacgaaagccacctcaagttattctacgaagccggcgaccgaggcgtctggtcaattggctcaaaggtgatactaaaggatcgaggttccaaccttccaacctccgaggtaccaaatatccagttcgtgcaggagcaaacctctattcccgttcccactgtcattaaatcctgggaagagggcaaacacacgctcatactgatgcgacgcatccccggtgaacctttgagcaacgtctggtccaaactgacaatagacgaaaagaataaaattgcaaagcaaaccgctgagtatctccagcaacttcgcaatctccaatctgataaaatccaatgtcttggcggtcgtcctgtgttttccaatttcttgttcaagaacaagggattaaatgaggttccccgcggtccttttgcatctgatgacgagctatgggctgagatggagcgtgggttgaatgagaagatcccagaggctgcaagagtacggcttcgacagtgcatgccgtctgccatgccttatacttttacgcatggtgacctgacaaatgtgaatattatggtggagaatggtgagcttactgggattattgattgggagacggctgggtattttcctgtgtggtgggaatatgtctgcacttcggttcctgatagtgaggaggatagagagtggaagacgttgttgcgacagtatatgcctgattatagtgtcgctcgtggattttggttggaatattattatctttgcaaggatctggatagtgaaagggcgaagaggcttctggagagaatataggagatgagacgggtgagtgagggcaagctgttgctgtgtaggttcatatagacggtacagagggcgacctgaatgagacactggcttgtttataacatagatgtgattatattgcatctgtaagcagaagacgtacaattttcctctagacctagtctatcatgagactttgggactactagtcccacctatccccaagaccacactctggaagcaaccccaacactgccccatttcccccatgatatcgctgcaaatacaaccgaatagcaggacattccactcgagccctaagtccaatccaccaaatacaacgcccagccttgcgataccacagatacagcaacaccaacgccacaggatccctctctctcagcaacccctcaaaccgaccatgaatacaccgcataaacatttgcaccgggcccatcgtaacttcactatcctcaacctccaagatctgcgctaccgcatgagcagcttggaaatacgggttcgttttagccgtagaatcctccgtgataccacacagcgccgccaaagccggcggtataccctctgtacctccttcaggcaacggcgaatgcacataggcgaacgtccccgccatgacatgaaagatactatccgatcgcagcgggttgactatattccacaaggacattttgcccttattcatatacacccagtccagatgggaagaaggagaggggttcaaaggccaagattcttccggagtgcgtgcgttaggggatgagaaggttaggattaccaacgcggctgcagtaccccagattgggtctctgtctttggggtctatttgttcgcggagcttcttgttgaaaaggatggtgctttgtgaccagtggtagcattcttctagggtgcggtggctttttggtgggctgttcagatggcggtcgtaggtaagtgatactgctagggaggcgtgcattaagtagggatgctacaatgtggtgatcagtatccaagattggagcttatgagggaatggtcaacttacagtaaaggccagttctaggagcttgcgattcacatgtcccatgtttggatcatcaggggtgatgagactgcgtcctaggtaccgggtgataaagtcttgacatctggtattcagttgatagaaggtcgatgcgtctgatgtccagacggcattggtgagagggggctgcggtcctgctgctgctgctgcacctcgaaccatccatgaccgtcgcgtgtcagcggcaatggggtggaggtccggggtggtagtcgataggaagttgcatactatcccgaatgaactacatcgcttgcattgtggtttgctttcgtcgcactacttgatatggatcagtggagatggtttatctacgaggtgctaggggcacccaccttgagtttccggagcttgcaattgcggcacccgaatctcgatctccgccgtgacctgccaggacccgagtcagtcgatgtcatcgtgactgaagggaattgatcgctggaagggttcggaatgggtggtagtcatggcccccaataactgcatttagtcatacgctaaccgagtctcggatgttgcatctcaacgctaaacccgccctcggaagcagacagcgctgattggctgccacttgcctccaccaggatcagctaggagtatacatcaagaggtgattgacatgccatgatacatactttcagatataaaaaggagactattgctcaatgtctctttcctggaaatactaatttcaacttccctccgagagaataacttgaacttcgcttgaaaccccacaagaaccctctatccacactacactacaactactacctattaagagactcacttgcctcaccaccaccgtagttatatacactactactatatcggagaaaatggccacccatctcgccgcccttctcccctctaaatcctcccccttcactctaacaacccgcccgacccccaccccaggccccaacgaactcctcatcgccgtcaaatctatcgctttaaatccagcagacaccatcatgcgcgacacgggcctcttcatcccctcctatccaacagttcttggcttcgacctgtccggtctagttctcgaagtcggcaccaacgtccccatccatttccgtacaggaataacccgcgtcgccgcctactctgcttccgtctggaaggcctgcgatccggactatggtgcttttcaggaacgatgtcttgttccgtggcagcatgttatgcctcttccggatgagggtgtgatgtcgtggaacgaggcggctacgttgcctgttgctgttcaagtagcgcttaatgcgtgggagagtgtgggggttatgttgcgggcgggagatactcaaaataatgataagactaagagtcagaacgtgaagaaaagagaggtgttattggtctggggtgcatcatctagcgttggttcgatgggtgtgcaagttgcccgagtgcttcgggatcaacctggttcttcattcgctgctgtgtatgcgactgctgggacggcgaatcatgagtatatacaatcactgggtgcggatcgggtgtttgattacggagacccgagtgttgtggatgagattgttgaggcggctaggaaggatggaagtgtgattcggtattgttttcttgcggtgggagatgtacggatgtgtcagggtgtgctgggggcttttgtggggtttgatggtgatgaaaaagtgaaggggaagattgcgtcggcgccagtcattcccgcggatatgaagggggcggatggggttgaagtcatctttgtggtgccatcgatggatgatgaggggaagaggttggatcagtttcggtattggttggagacgtgggcaagggagaatattgctaaggggaagatcagaccgagtccggagctgagggttgttgggaggggcttacaggctcttaatgatggcttggatgagttgggtcggggagtgagttgcacgaagttggttgttgaaattgcggagtgatggggctaagagtgatactttccttggtaaggaggggtgtggaacttcagaactagactttctagatggaaggttatagacatagataatactatcgagtaattgccgaagagtataccagcggcatgcacagtatatcaacgagctaatcgttgcaaatgagcgtaggaagaaggcagtaagctttggaagttaataagtatcaatgcaaatgaagtaacttatcagaaagaaagccatatgggtaacaagatcaggcacagctgttacgacaagcaaactacccccaacctcaactttacatcttcaacagagagtactggctgaacttctgcatcctcattctgtagaggtggaaacaaaaccgagtccacaacatgacacactccatcactagctaaaccatcctgtacagtcacgtttgcaattccattcaccttcattgagataaggcccccacatcgggttacagcaactgccagcgtctgcccatccaagcacgtaggcaaggagaagcgacgaactcccttgagcacacgccacaaccgatccgactgggtctctggagtaggaatcgtatgatcaggggtatcttgtggcgtctgtacaaaatgctctggtgcagagttctggtcataaagacgattcgagtacaatgattgattcgcaatgacatgatacctcaaaagagcttgcagagagatggacccttcatcgctgaagagaaatgtccgaacgtcctcaggcagcctgcaaaaggcttcgttggtgggaatgaatacggttccaccacgacgagactcttccaggagaatattctgaatagcttcagattgtttcactgcagactggaacaggtcaaattcggatgacggcagagcagcgagaaaagctccaatggtgggtcgcgatggcagaatttggtcgattacatggaccagaccgtttcccacgagatggtcttgttcgattacggttgcgtgggagttcacgcgaaggccgttgagtgaaggacggactgttattctctgggaaccgttcaatcggtcaggatgaaaaagtgtgtcgactgttggggctgttagaaggaaatataatggaccgaagtatggagagatgtgtgtttgaaggaaggccagaatatcttcctcagatagctcattgctcagttgctcaagtgcggtgttgcttgggacccagacggtggatgaatagtcttggttttgcaatagatgcttgatctgagggacttggtttaccagtcggatgaactcggacgtgttgggtttcgctgaaaggaactcatagagggtcactggaattttctttgcatcgcccaagtgtggcatgattgcatgacagtatccagcatattgatgttggagatgctcaaggctgctttcggttggcgcagctgcggtcacccaatgctcgatgccgggtgcagtcatgataaccgatgatgggaggaacaaaaggcctactgagaggggagtgaggtactaggcagcatcatttgctgatatagtcccatcgacccccttgtgttcgcgccatagacatgggtatatgcgttgataagagcactagtgctaaggatagtgactagccagaggctgctagccaatgaccagcattggcgtagtcaacgctcaatatattgtagataagagtatagacagacaagctcctcgaagggcaagcccatttccttcctcgtgcattagtgccttatctcacatccctagttctgtcttcctgatcctactggaaaacgaaatcaccagccagaatcgcaatggctcctaagggcagatacttcatcctctctaacctcccatactaccatcaactttcttcaccccttcactccccaacccatccacccacccatccttccgatgatgatatatctccatttccaactccgagcacttaagccgatgctcatcatcaagcgtgcccgacttcaccgcaacaacctcctcatcgtcgctcgaccgtgaagtaaatggtgttccgcaatcaggacagaactcacgtaatacctgcacgccccttttgctactgtcggtatacaacttgggtgtgcccttggtatactcgaaactggtctgtgggacaatgatgttggcggaaaagccggagccggtatagcgtttgcagttggtgcagtggcagatgatgagctggtatttgtcagtgaccgacttagttgattgagtcattgtaattagttaagaatgtccaatagtaccttagggtatgtctctgggtctggcaaggtaatgcgatatgcgatattcctgcagaggcaggcgccagtcacgatgttctgagccatgatgagggttggagtcttgtagctaggggacaggctcggggttttattattaggcttttagcatgtcattcaaagggcgtggtccgtgttatagatggcggaaggcgaaataaatagcttcatggccagatttcttggtcgccaggttcgacccactagggtccatactagcatgattccgaagctatttttatcccgtgatggatgtcatactggatagcttcaagaaaaggcgtgattctgtagcaacattgattactatagtgcttttctgccatgattttctagaactctatttcggaacaggcaggcatggttcttgatactgtggtcactttgaaatgacgggccagaagattgaggtgctgatgaactctaatacgaagccaagagaaagtgaaaccggaatcaagacagaacgcgagcctgcgcctaaatttagtccacactagtgagaatgctaagttaatgtgtgtaaatctattctgctgatatcggtgcgactctatgcggacagcattaagtttttgaatgtattgtgcaaacctgagtgactggttaatccgaatctgctcctttaggaagcttattagcctttgcactgagcattcggcgggatattacgagacaaaaactttgagccaacttctatttggcatccaacaaaatgcagattgcagaagatcacaagtagtatacacagtattgaacatggcagtatgggatatatacacaagcacacagccggaaatacaaacataatacaacaatagtgaaagtgatatagaacaaatgccatctcaaactcacagcagatcgtcaatttcacgaatctgccccagacagtgcttctcgctccatcgaagtgcaatcgatttcggatcgatgtcaatgcggcctagcacggcctccaactcatattcctcatcccagccctcgatagtctcgtgaagatgggccttcttgtacagacgccgttcatcgagagggcgctttagcagccggcgaccggcctttttcaccgtcggattggtctttagctgccaaagctggggatcgccttggctcttcttctccagtagttcaacagcatgggacagatattctgccttctccatgtcccgagacacatccttcgacccttcagctgagcttagctgacgatgcaggtttccagtgacccggcgggcttcgattacaaagtcacgatttagtgcgcttcctcgggccagagcggtcaggatgcaccaccgcatgccatgcatatttccagttgctgcaaatgcacgtataaacattttttccactcagagtcgatcaaagctcgagcagcaccgacaccctcttcgagtagcgtacaaatgactgcaagttcaacatgcaactgcttgaactggaaccgcgcattcctagcattttcatagcacttcaacgcctccgtcagcttaccgacatgcatgtaatgagacatctgcttgtgaagcttttggtattggtcgactggtctcgagggtgtcatgtgctgcagcgttcgctgataccacggtaacgggtcctgcgtgtacggcatcaggttgacttccgcaagtgggaatgatcgctggtcatatccgagcacttgttgtgatgtggcagcttgcccatatttcatccgagctgcctgcagcatctgccagaatcccactggtgcttcctcaagagcgtgacgacgtttgcgaagcatctccaagaactcctgctcattgatgtagttcggccaacggcgctcacgtgcgaaccgcacaaattcatcaaccatttccttatcacccttttccacgaatgcctccagtatgtgcttgtaaaggattttatcgggaaccatttggaacttttcgatgtaacgatagacaaagtcgcgaatttcatcacccgaatgcgatacccagtattcaaggaagatacggtcaaatatcggcgtaaagtcgtacttcctcgaagtcaacttgagctcatgcatctgctgtagcccagcgtccacgccctcccagtcacaggccaaagccctgccaaataccaaaagaccttttgttcggcaacgaaggggaatgccgtacttagtcgtcatgtctttgaccagagcttctgcatcagccagccgaccaaattccacgtatgctttgatcacggggttgaagagcttgtcggtgggttcctttcccaagcgaggaagtattgtcaaaattttcttcagttgcccgttcagaagctcgatactccttgtctttttccaaagccctgcaagataggcgccgcataggccgcagccacgatcaacctcgagattcctaagaagaaaccatttcgctgtggtaagtcgatgagactctagcaggcatcggagcacgatatcaaccatttccgggggaactctgaatttgtgcatgtatcgagtgaatatagtggcgacggattcgatgctcccctttctcgctagcgcgaacatcaaaactttccacatgccaggagacaccttatccacgtcttctaggcgttcgaagatgttcctcgcaaccatgacgttctcttccttgcaattggcatagaatgtcttgaccgtaacttcccgtctatctgtagatatgccactcaccgtcgcagggtgagcgtccaaaaacaagtgggcagcatcgataggccgaccgtggtcgagaaacttttgcatttcttctgtgactgaatcatgccattgagctgcatcatctgtttgcttctcatgatcttcgactgttctttggttcgcatgtgcaagggcggattttgctcggtccagtgcatcggtcgaccgtgttaggttcggagggagatcgggagctgaggtcgatttcgctggtacttgtccgggagtaaaggagtcaatcaactttgagcgtgtaatatccatgtaagactcagcaggggcggcaggttgttggtcttgcagctgaacatcccagctcaagtcgttaccatgaacttctcccctagccgggacagcttgcgcctctctgaacttccggtcttgctccttgagagattccaggcccataaactctcccgcctcagccgcctccatcatacgtgccagtctccttgctgcagacgtcgcatcgtagttcggcgctgaggtttgcagggcccgcttgttctcgacaattcgctccgcgacgcgcacccgacggtggacgtcgtaggtaatagctgcaaccgtacagaagcttcccacagttgatcctgcaagagctaaacgacggagcactcgtagggcatttcgtgagggcacagctggtgtgccgttggtgggtttggagaccatggtggttaaccttgtgcaccgctgacagcgggctgggtcgaatcaccactaaatcattaagtgaaaaagaaggctacgaggattcaatgacagaggaaccgtcaggaaccccgcgccggccggtcaattgggtcaattggagttctatgatggagtaggagggactcggagctcgtcggtcggaaagtttgcaccagcttggtcgaattggtcgctaccgcccgccgtaccgcatccggtcttttcccggtgtgcccactcgtcttactaacattctttacccgccctttttccgactcaactactactactaatattcggtgctgtgaacaacactacaatggttcttttacggaattctatcgaaggtatcacttggtaccaaattaaatccaatatatagtctaacaattcgatacgccaattgtgacgaagatcagtctaaccgtgacccatattagcggtcgcatgcagtatagtaactgctcggctccacttctagcatcactagagaatagaatccgccacaaagccttcttcattagcctcacctcgaggactacttgggtaagactcgtcaagagtaactgccaaacaccgactcgttagcagacattcctagacaatgagaaaggagggtcacctaccatgtggtttaatgtaaaaactgctacagaaggtgagcaagaacaaggcccccagaacaacaaataccgctggagtgaactttccaaccgtcaggctgtaaaggagactgcaagcggttggcgcaatcactcgagccagcgcatgcaagagtcctttcgcaccaaggatctgacctaaccgttcccgagggacatgtttcgtgagagatgattgcattgtcggtatccccatgccgccaagcgctgtgactattcccgagaataccatgaaggaaccctgatttgacattgcatatcccacatagccagccatgtctaataagagagaaagtcgtataagaacaacttcgcaggtgctggacccgggaacgatgtgatctggtttgtgtggttcacggaagattgcggtgataatcggatatacaacaaagaggttcacgactcgggcgatgctgataattgatatgaagaggcttgattccacattgccccagtcgaatttgtactcggcataaataatgaccacttgagcggttcccaatgcgaccccaaatgcaatagtatctatcgctgtaagaagaataatatttctgcgcaaggccggactcgcgccgtgacgattagggaaaagcgtgctgggacgtcctactggcggtagcaaaacagataaaggtgtaattagccttttggggttgaggttctccagactcagccagcctgcctccccttcgtcgatgacttttcttcgatgattgtctcgcgcttgctgctgacgttctgttgataatgattccgggataatggtcataagcgcaatgaggtagagcgcatgcatggccaatgaggcctcaaaggtactcagtgcctggcctgattgcttgatcaagatagccgccagcagaggcccggctgcaactccggcgaaaagagagccgtacacatacccgaatcccgcactccgcttcgatgggatggtgcagtcggaggcatacgacattgtcagcgccatgatggtggtgaaagaaccacagacgccatcgacgatggcagccactagaagcacattcacagatacaaggtctggcttggctgcgacaaagacaaagatagcttccgccaaaacggtccccaatgcgctaagggccagtatctttgtcctaccgtagcgatctgataggtgacccagtcgggggcatgctagcgcagatagtatcccggccaggagattgaaatacaactggaactgagcaagtaatgactgaacttcgggtgtctgacactgcgaattcttattcccaatgatgacaggcaaatacgtgaaacctggatcctgggtcgcttttctggccatatagtctctgcaaatgagagacatcatcaggttaatcttgggcactgcagtgccgccgaatcctagcatataaatgacaagaaatggaagaatccaaaggacctgttgcatgtcagaagtcgcggggccgaatgttgtccatcgaagatggaggcactcacgcttggccttctccatgtctgccaaagacctttttgatcggtgggagcatcatctcgtgggccggcccgataatcaggctccggttgggattcttcgttgtcttgttgcaataatggggttcgctcatgggtgtcttcccaagtctcaattccagcatcaattggcgcaggggcgtccagaccggcttgcagtcccgaaccaacctcggcatgcgcagcaggcggtgcgtcgcccctgattgtggacattgcgcgaaccatttcgcaccaggagcaggaataatgggtatagcagatagaactgttgcctacatttgcttgctccggagttggaacaaaataacacttggggtgggctcagaacatttaagaaccgggcggggggagcgaagggagccggcaaggaaggactaagatgaaagatggacaatccgtttgttggttaaactccgagcaggtcgcttatcaatcggcatgaaacaaatgacaggtcagcaagtgttagactggacaaatgccagcgcagtgttgtatctctactagttagatagtggtgacgtgattctagaaattcagactaggatagccatgactggtgtgtggatgtagaagttgtttcacggttcatcaagcatgcagtctcagaagcaaggcaagccagctcggcgataacgctctggactccccgccgcctcgggccacttacatcactccacgctgtcgaccagggggttcgaagtgtcccccattcccagttctagaatgtctcgagaggcagctgccaggagtcaaacacatacacacacataagatactctggtaagtggtcagtgaccctgctgctgtctgcttttgggatgcaccctatcgcagcccgccaaaataacttgagggagacacttcgcccacgtgaggaatttgccgaaatcgtaaaccggaatacattgtagcttgttgcttgtatagacacactcagactatcgtacacaaaacgccttcacatacacacatcaaacgacaaaccccctgacaaagaaatgaaaactttagttcctagcaatctatactaccaaagatgctccctcttcaccggcgaagaacttcttttgctccaagcacctctcactccggcagccttgacaacgcagcgtcatttggagcgagcatttctcacccttgcgcaagtgctcttgagcaaggtctgcaagggcctggatgaatacggggctgccgttcagactttcggcccgcttgacacccggggaattcgcctcttccatgacttcgagatccagctcatacagggtctcaatgtggtcgctggtgaaggcgatcggtacgaggacaatgtcggtctgtccacgcttcacgtactcttggacggtatcgcttgtctgcgctcccagccaagcccttggtccgacctgagactgccagcagaggcggtaagggttgctaaaattgagcctttgcatcaccgcatgcactgttgccgcaacctcggccgggtatggatcacctaaaggagaagttgtcggttagctaccgggagttggtcaccaagacccttgagactcacctctgttcacaacactcatgggcaaactgtgggccgagaacaagagaaccactccatttctcttatcttccggataggttttgagttgatcctcaatgtttctcgcaaacgcctccacaaggccagggtgcgtaggccatctgtcgataacgctccactggatagctccggaagtgtccacgtttccgtttgctcgcttgccctccagccgattcctccatttccacagctcattcagagagctacccgtagtagaacaggaatactgggggtattgtgagaacgcgaccgcacgaccgcccttcccattgccaaagccatcttccagcaattgtgtgtacatttgttccgtcagcgggttggcgtaacggaaggcaacgtacggcttgtgaggcgcagtctccgggttgatcttgtccagcagcttgcacatttccttgcattggtattccgaccattttcttatgggtgagcctccgccgatgtccgcatactgcttttgaatcttgggtgtgcgtcgtttcgaaataagaggcccgaggtaatgctggaacttgccaagaggaatcaaatcgccgtcggccttgaatagaagtagaatgttagaaacgtagcaaccagaatgacagcttgccatagtcggagacgtacaaagagccggctgaggaaatcctctacttcgtctgtcgtcgagggccctcccatgttcaggaagaccatggctgtagggcccttagagcctgttgcatcctgggtaaccggaggcactgttgttgccagcccacatctttgttcttgcttgtatccgaacagggtgcgagaagccggtcgcagcaattgccggggcagggtaaacgggcggcggagagccatgacaggtaattgtactgaattcggttgacctagtcaatggaggtaataagaaaagaccgttcgtatcgcgcaagcagatgaactattcacgccgcattaaatattcaaaagatggacgagtggcaagaacaggtagtgggtgtatacaacagcgcaaggccttctggaagctgaaaagtccagaacggcttgatgacggagcaccgagaccacgaccaactccgactcccgacagccaatgaccggccagctagcgtcatcaattaccgggcggacatcacatgatgttcgtgtctccccgcgtctttctgcccaccggtttgatcgcgtccctcgcgaccggatccagtgacgatatagatagatctatctccggctgcaggcagcagaggccaaacaggcagacacaacagccccacttgttcctggttacgattcaagttgtcttaacctttatacttccctctttcaatttcgataatatcttgaatgctttaaacgattccacaacattctactatggcggacggcaacccacatcgggaagatgaggcggccgaggaagaagaggagattgatgagactgtacgcaaatttacccatgaacttggactggaactctggaactgacaataagatcagagctacaaaccagtcaaagatgcggtcctcttcgcaatcgatgtcagcgattccatgttgacgcctcgcccctcagcagatcctaagaaacacacccaagaatcacccaccacggcagcgctcaaatgcgcctatcacttcatgcaacaacgaatcatatcaaatccacaagacatgatgggtgttttgctgttcgggacccaggcgtccaagttctttgaagaagatgaagacagtcggggagacctgtcctaccccaactgctacctcttcactgatctggatgttccttcggctcatgaggtcaaaggacttcgagcactggtagatgatgaaggagactcaagggaggttctatctccagcgaaagagcaggtctctatggcaaacgtcctattttgcgccaaccagatattcacatccagagcgccaaatttcctctcccggcgtttgttcatcataaccgacaatgacaacccccatggtgatgataaaaccctgcggtcagcggcgactgtacgtgctaaggatctttacgatcttggtgtcacaattgagctgtttccgatctcacgccctgagcatgagttcaagaacagcaagttctatgacgtaagctatcatactctatagcaaagtggcaggggtcgatactcactacagatacaaaggatattatctacaagtcattgcccagcgatccagaggcgcctgcatatctacaatctgattcaaaagcggcgactgcgaccggggacgggatttcactcctcaacacgcttctgtccagtattaattcgagaacggttccgcgtcgcactcatttttcgaacatgcctttagaacttggcccagacttcagaatttcggtatcgggctatatactcttacgaaggcaagcgcccgctagaaactccttcatctggctgaacggcgagaagcctgtggtcgcgaaaggagtgacttcccactccgcagatgatactggccggactgtcgagaaatgggagatcagaaaggcatataagttcggtggcgaccaagtaaccttttcgcctgatgagcagaaggcgcttagggatttcggtgagccagtaatccgggttattgggttcaagcctatcactgcgcttccattctgggcaaacgtcaagcacccatattttatctatccatccgaggaagactatgtaggctcctcgcgagtattttccgcattgcatcagactcttttgcgttccaagaagatggcactcgtctggttcattgcacgcaagggtgctggccccgttctcgccgctatgatcgcaggcgaagaaaagcttgatgagaatggcgtacaaaaataccctcctggcatgtggattcttcccctccccttcgcagacgatatccggcagaaccccgaaacaacgttgaatgtcgccccggagtcattgattgatcagatgcgcgtgatcgtccagcaactgcagctgccgaagggagtgtacgagcctctcaaataccccaatccatgtaagtcacttctgtcttgcattgctcgtatacgatgaacgagaagctgacagcccgtgatcagcccttcaatggcattaccgcatcctacaagctctcgcattagacgaagatctccccgaaaaaccagaagacaaaaccattccgaaataccgccaaatcgacaaggtaaatccaccacacccaacacgagaaataaccctccaggcgtccaacttactgacaattgcaccacagcgcgccggtgactacgtattatcctgggccgacgaactcgaaaagcaatacgccaaaacctcagcagcggcccctcgcccaaccagcaccctcgtgaaacgaggatcaaaagaccgagcaagcgaaaccgaggactccaagccatcgaaaaagatcaaggttgaggaagactctggaagcctagaggaggaagtccgcaggcatcacaagaagggaacgctatccaaggtaagccaccacaggctttctacacgtcctcgtgatggcaaatatgacatcgtattaaccggcggttttctagcttacggtcgctatcctcaaggacttcttgacttccaatggacgctcaaatgccggtaagaaggcggatcttattgagcgggtagaggagttcttggagcagtgacatggcgggattgttggattcgctagtgcgcttctgttggtggatgtcgttatgtggtgtcttatctcgggttaggcgttcgtgacctgaggacatgagcttgtaattaatgatgggttggatgtcgcggtattcgttcttcagcgaaacgtaatggacacgtattttaggcgatgtacagttataaaaaatcgaattcgctgggctagccggacatgtcaaaacgaagagcattaggagagacatatcaggtccaagtgctatctttcaaaccagtcgcttaagatcaccgaggcatttatctccagaaaattcaccggttcagcaggtgcgcgtatcccgaattcaaattaatattggaacgatcgtaaataaccacccagattcgccgtaaacgatagtagtcaggctttgccgccgacagaaggggacgagtatgtcaactgagtcaacttgaaccgagcagtccctgtaaacaacgccacgctgtttgtaatatccctttagaaacgtattgtcgctggcaattatccacaaaaaatgagtctaaacgggcgaaaaaagtcacccgaatgggagaatatgtggaaagaagaaagaaagagagaccaaagcaagagagcgccgaaaggaagctatcgtaatatatacaagtagaagccgtgggtatttttataaaaagcagaaacgttaacggtatgcgtacaatgatcaacattgtccataaacttgacagtagcagacttcttcgtcgggacagctgagagtagcaaagtgttagtatttaggacgcattcagcaggtagggggggaggggtgcaaaggcaacatactatattgattctttgccgaatatgacatgccagagaaattccatgacacggccactactggcgtcatccttgtcggtatcgattatccactggcggatcttgatgtagtcctctcgtggtcgtcggtggacctgctcccgggacacggcgaattgcgcacagcacgccgcgccaatctgtttcggcatttgcaggaacttctggtatttagcttcgtcgtattcatcttgcatcgtaaggcccccggtggagttcaaaggcggggtgctggtgccctcaaatatctctgcaaagacttcttccgtcacgtgctggttggtgcgatggccctgcttgcaccccgggttccagttgcagcggaggttgacatagccattgtcttggacgaagttgagacgcagggatttcatcgcaatgacattgtcgtgtaagggcgcatctacatgccaggccatcaggaaacccgagcgatgggaatgaaggaaagcaatagtggatggtagggtgtcgtagtgatcaattaggtaggtgagataagccatggactcgtgacccttgttcagcggggttgtgagtattgtgccgtcagctgcgacctttttggagggattcacgatgtatatggcacgttgccagctgtggagggaagctattagtgcgccgaaacattgggttgggaaggggaggacaaaaaaaactcactctggtagctcctgctcgacccattcagtgtgctcttcctgtagcctggccatcacaatcactttatcccctggtgtgacaggacgagagccatttaatgtgttcatcggcgggcgcaaatccagccaattgatcagatatgcgcccgcgcgatactgatcgcaaaggtcctcgaggtggatcttcaagagatataagggcaagatgagtgctagactagcacatagtgctatgcgagcgccccatctcatgatgaatggctaaaggacggtagcttctgtgcacggtacgggactgtttccagaagaattggtgaaaacgccaacgaggaccaatatcgaaaggccgttatcgatgtaatgcaggttaaaatctgttcctctcttctgcaggtgacgaaatcataggactatgaaggtggatgttgtcacaacacgggttggtgtaaggaatgacttgagtcgggaaagaccgagaaagatgaaagacggagaggatagtttcgagcattaaaaggagggtcaatcctattaaggaagaatccaaaagaaggaaaagaggaaaaatcgaaaaaggagggtaggtcttggaggggctatatgtgaaccatattgcgagaaacagaggacgagagtaggaagagagaagacggacgagaggggtcaaggcgaggtaatcaggaaaggagactggaggaccgttgattaacctattcgtctgcctaccaaggcggtaggtgcagtagtaggagaagtagtcaaggcaccaggtacttttagtgactttggactaaaatagtcactaagacgagtaagttagtggtggaggggaaggtccatcgaatgcttccaattcaagcccccatctgcctccgtctgtttcgcccgctctcaggcacttcgaatctttcaatccgtccgtctgtctttttgggtggcgcggcatgggggcagtggggcgtaaccggaccccccactggctggccacgcgttaaaattgttgctatcgtttggctccccaaagatgaagactaagggggaatggaagaggctgtcataggctgttgagagacggaggtcccctcagacaatcgcaaaccttaagggaaccactttcttccttagcgggccttagcggggaagcttggcagccgccaagtttagcgtgtgagcacgacatcttttggggatatttgggacctacgattacgaacttacgggtgatagtcctccctgtatctctcatggtctctcaaaagctaaccccttgttccttctctggaatcttacagcccatgaaaaactcctccccccctcgtataaagagttgagatcaccgccttccatgcctcaacttggctgtgcaaaccatggaccattggtggcggtcaacctttgccccttgacgggatgacgtcgcggcggccattgcgcgtacgtgggcaccactaatatctctggccaatatgccacgcagctgcgacgctaatcggccatggttcgcatgtcacagccatcgttcgaaaccaacgttctacggttgccaagtttatcggttgagttgccaaaacgtcaccccggatcggcaacattgtctcgcacgtcccgacatggtggataagagaatggccatgagacactgaaacagacatgcaacggtgggtaggcgacaccacaagaaccatggcccactgtgtaccaatctatatacgtggacagctggagaatggatataatatttgcccgccaaataacaagtgcctcggggatttatccactgataagaaaagtcaggctccatccattcggatctaatttctttttccattcagcttcatctcgccgccccgcccattttgtgtcttgactctttttcggcttgtctgcctcacataatttgttgttctcgtgtcgcggattctttatcagtttatcttttgaggtatactaagcaagtacttggtacttttccggtttcggagaatcctaaaatagccttaacagtcaatgtggcgcccagcaaggcttagcaaagctgaccttataaggaaagaaaatggcccccaggattactagtggacattatcagtagccgaatcagcaattcaagcaagcaaaaccagtgcggggaggagaccaaaggattacgactatattaggaagatatagttatcaggcaatgctactttagtcagtcccatacccaggcccagctgccagtattgcggtagtactgctacgtatcaaacctaaagagaatcaatcaccatttttctaacctagattactccactaaaaacgaccttgaaggctttctgaaagtccctctgtgccgtgttagaaatgctattgaatttcttctgttctttctaggcacgcttcaaccaactcgaaagaaaatcatactcaccgagaactctagaagctatcgaaatgattggcctagattgttggatctattgaacgatcattctatctgtcacggcgacgcagatttgtatttcgcgagtttttgagcactacgatacgaagaggggggtgcactcaccaatatgggtaatttgagcgaatataacaaaagtcaatatgaacatcatctctctagatatgagaaggtgcagcttcttcgtgaaatatgccaatgcatactaaagtcacctgagcttgcttggatgcacaatcagtgtgtactgctcccatcagtagtatgtgtccggttctttctactatatccataccttaaccaaaccaagagaaacaactcacggttgtgatactatactgcagtatgcttgacataaactccaccagcactcttgaactcattctaataaaagctttacgcaaaccattttacccacatgcacagacttataccgcaatagaagaggcggagcaaaataccactatggtccggggtagaggaatattgtgattagtgaaatagatcagctccactcgaaagagagagtgtggatccatacatatatcaaagggctcacaagctgcgatggcggagaaaacccgtcggactccttcggcttcgctgtggacaaagataagtattaccatggttcattacgtcgttgcctggctcgcttccccagagaagtgacccttcgcttttccccaaatctcattccaatagaagtgattacggtattttactacttctgatcagccaaggcttatgacttgaaggtctttgcaggatttgtgttgatattacggaatggcttgacccacgtattttatatagtgcgcggcagcggaatagtatgatccttgggtttttaagagatcaacgtcgaaatcgctaacaataatataagatatcaaaggtaggtactactctggcacaagacaggttatgtttagtttcattctcttcccttattctagttgtcttattttatcagccttcaagttctttttcctatcgcaaaatccaaggacttgcatactactgaaagaaatggataatgcaactactgcctagcactgtggtatatagcagaactacatgggcgccgctatatgaactaatgcccaagtaaagttatatccatgaaacaacatactttagcgaaggaccagtaaatttttgaatcccagaattgtttttgtgaagcagttgtccaaatgtcttggcaaccgagtacaaaggagcaaggggcgcacaataagattcaatgctatcaagtcgcacaactcagatggatcaaagtttcgcttgttctttctggtcctttcgttcatctgacatctaaccattaaatcctcagtgctggtattgaacagctcaccctttctcggtgagagagtttctggaatgatgcgtcatccaatgtggttgacacgtggttcatcccctacgtgcgacattgcaggacctgcagattgacagatcgaggtgacaatggacacagcatttgagcattggggctgtgcatcgagttgaaactaagtttgtcgtttgctttccttctctcaattagtcctttgtaaacatgtgcgagaattaccagtgagtattctgtgtagggtcccaatcacatgaccataagtatttcccgatcggcatcaggtgactggaagaagaagaagaggcatccatgcaaacctagcaaacagcccgcctcaccagctgaagactacttactatctttaagtagtattaccgaatcggcaaaagtgtggtacgggtacctctccttgttgaatgtcgggtaccgtgggtgggatggtttggggcaccgcccgactggtttagcagtgagcgggaatgtgatggtggtggtggtgatcatcgggcaggtcacaccctcgcaacttaaaatgggtgtcgctacgcgtgtgcgggagggcttacttagttctctccggtagttggttaggttgcttttgtactttgtggacatctgaataaccttcaatgtgcttgtctggttccaagggaagctagctgatgacagacccctagtccggtagatcgtgacttgtcccatgtccctcttccgatatggcgtcctctctggaggatatgtatggatggagagtgtggtgtcaagcaaacaatcaataaacgccagatcccaagatcggctcccccctcccaatcggccagcattgccattacgtatccgatcaattaatgcttcaggcaccatttgttttggctcctctgctgcccacaataattctgggaattatttgccgttagccttgaggaaaccttaccgtcctggtgcaggcacagctgcgacttacgagtagacttagcagagacaagaggaagagagacagagccagagccaggcataactagaggggggggaaatctgagacttgagacagactatctacttgttagacggtcggtgctgaccggaggggaacctgaggcgaacggtgccccgaataatttaattcccctgccggggtggtgggctccttttctttagtgagttcctttctggtggctcccctcgttcctcacaattactgctaacagcctaactcactccgggtaccccaagattagtagtgagtgagtagtgagttagtgaggtagttaggctagttagttgttattctggttagggtgattgactcttgtccatccgtccctctcttccctctccctccctccctctctttcccccgcccaacgaacgagtcgccctcgtctcgttgaccaacaacaacaacatcaacaactggcactcgctgccttgaatcactccctcatttttccccttccccctctccccttccaccacttcaatcccccttccaattgccctttcccttttttccttgtgtctacttccccttcggacttaccaacttcttactttgcctttctcttctttccctacttacccttcctttcgcattgaaccctggtccttccttttcttctaccacgtcatttcactcttaataatccctacttatcttttcttgatcttatctattgattgtatagtgtggacgcttcattgcatccgcctgtacccgtaatttcctggatccttccctccgtcctttggttcttattctgcgcccgcttctcggcgactcccttgtttcgcccgcacgccgctgcctcgtcccgaaggcgcacatctggtcgcacacgcacaaggttactctgcgtttgctagacaggtacgcgtttgttgtccgaagcttccttgggagcaggttttcagtcccttgctccaaagtcttttcgtcacaagcgaggcgtaaccgccaccttcggctcccggtatcgtattccgccgatcccaagtgtttttgttgtcttcttcggtcggcaatcgacgcggccaccgcagcgaatcatcagccagcaacgcgcatcccctgttgtttgacggtcgcgaactcttccagccccgaggtgttgcgaagatcgggtcgcaggtcggctcaccgaatcgccattcgcattgaagagaggaactaagattaagcaagcaggccggcaacgagatcgtcgcataaccggaggatgaccgaaaattaaaacgaggaaacgagaaaacgaagcgacgagtgtgcgggctattgacgttggctgtaccctcaccctacgggattaggcacagcctgctgttcgatcagccgcaagagtggccgtctcttcaggccgcagcaccaacgcccctatcgatggtggacgacggacaactggcaacatgtcgacaatcgaagaccctttcgtttccgcctcccaggagggcgtcgttcctcgcgagtcgcaccggtactcgtcctttgacacccagctatacagtctagatgcatcatccccggcgcaggcaaaacgagccctcgaggcgcatctggccgagacagagcgtcggctcgaggaggcgagcaagctcggtactgctctcattgagcagcagaaggagctcgaggagaaattgaaggaagtcgaacagcagcaggaggcgggccagattgggcccgatcttcgtcaaaagctcgcggacttggagaaagagtacaatgaaatcggccgggaaactgcgcgggcattccttgctccaaaacgcatggcgggcggcgaggatagccacttgggcaccccgtacgagcaaaaggtaggccgaggttattgtattaaccgctaagcgtgcgcaggttgctaattatccgtcgcagtcaccaatcagtcccgccctgttcgctggccaagcaacaaattctccaagtaaagtgagcgtaccgtctcgcaaacagcgaaaccaatcttcgacccgcgtccatgacatcgagttcgcgaccgagatttcgacctccctcctggctcaagttcgccagttacaagcgttgcttgctgagcgcgaggaggctttgaagatcctcaacctagaaaagtcaaggcttgagttggaggcagaggggtacacccagcgtatccgtgcactggacgagagcgaagagcgctacaaggacgagaactgggcgttggagacaaaaacccatgagctgatggcggcagttaaggaggcagccgatcgagagagtagactcaacagcaacctgggccttctagcctccgagaagggctccgtcgaacgagagcttgaggacttgaagcaagtcaatgcgaaattgatcgaagatcatacggcagcgcaaaaagccaatgattccgagatacatctcctgcgaaggaacctcaacgctggagatgccgagaagcttgctcttcagaagaaggtcgaggagctgaattcgcagaacgaagaactcgcgagagccgtggcaatgcgcattcgtcaacacgaagcagaatccactcgcgaggtttcccgtggccatgaatcggatgatcaagaccaatccacgccggagaactcccctcccccgtcgcccaacaagttcactcctcgacacaaccatctggaaaccgagacgttgcggagttcactgggccatgcccatcggatgatccagaatctcaagagcactatccatcgcgagaagaccgaaaagattgatctcaagcgtatgctgcaagaagctcgtgacgagatagaacagcgtcgtcgcgaagctgctgccccaactaatccgtcaagcaagcgccagaagaccaaggctgaggccgccagaaaggctcctcggcccgatttgctgggtgctggacggaagagggcagaaatcgagatccaggattcggactgggaagacaatgctaccgaagccagcccgtctcacaagccttccatgaagttgcaccaaggtcgtgtaggaggacaatcgtctgacgaacctagcgatgcgtaccagactgctaccgaggctgacgacacttttgagacggccaacgaacgagaaaccgcgaccgaaagcgaagctttccagaccggaattgaaagcatggctgacgatagcactgataccgatgagctcacggaaaccgaggagcggctgcaacggacaccgcgcggacgtgtgtcatccttgacactgacgaaggcccgcgataggacctcctaccagagtactgcgtctacctcaggcgatgaagacgaggattacgacgatggcttcccgtcgcctagccaaatgtcgtcgcctagataccggctcaggaagaagaggagcgtcatgaggaagattcgtccttcaggagaagccccgatggcttccaatagccgaccgtcaagtgcgcgagagtcccctgcgacgagcttcacccaaggcttgccatcctctgaaggtcagagtctgtttatggagcttgcggaactagacggagaggaagatgagggtgcctttggcccctctatgcgattcgctactggctcgcaggcttccaccccgcgcatgcttcccacccccgactctagacgaccctcggaggctatactcgacgcggtccccaagcctgtgatggttgattctggcgtgatgactgacccttgggtccccacaactgtagcaacaactagcctccaggatacgaacgatgaggcagctcgtggtttgcctacaacacccacgaagacagtcatgtctgatgccagcaccgcaaccgaggtagaggtaccgccgcaattggcacacgcggggacacaatggactcccatcgagacggaagtgaaggaggaacagacagttgtaaacgctgaaggtgtcagaccgaacggtcatccaatgcctgttatggaaacggatgtttctgcagtttctttccaagagactgttcctgtggcaccaaggttacccgaattcagcacctcatatgctgttggggttactaccgagcccgttgcgtttgctgttcccgaaccgccggaggttacactgtcatctatttgctcagagttgactgaacccgctgatgcaaaactccctgagcccgagcctgcatacgtggctgatatgaccgtctcggcgattgagttccagtctacactgcccgtcgcgccagctcttccagagccagcgccgccagttctgttgtccgagcacggcaccaataccgagatgcccaaggtgtctgtgtcacctatactgtcgcagcacacggagcctgttgaagcccttctggagcccgaggcgccaacccccgaagccgcggtagcatacgtggagcaagcagaatgcccggagattgctctatcttccattgttgctcagcagacacagccggcagcggctatcccagaaccgaaggaaatcgcccctgtagtcgtggaggagcaaatggtacccaaggttgagcttgtggtttcttctatttcttctcaacagacagagcctgttgatgccgttgcaccccagccagcgctccctagccttgccatctcttctacggccttccaatgcaccgagcctattccagcacaggtgcctgaactgccagtccctctggtgtcacaggtgtcactgtccagtgtcagctccgtggaaaccctgcccgtcaaatccactcccccgccacctgcaattcccgtgctcaacttccccgacgagaatgtggcccccgagtccaacgaaaaggcgcttaatagcagctcaataatggagcccccttcgctcgtggtttcagaagatactatcgacgatagtccagtcaacagtgctgccaacatcaagttggatgactcgctccccttgagtgccatttccgggaacgctgtcccacgtcacgcccggaagcattcgtcctccagccgagcagaccagggtgcccagacgattctgtcgtcgaagcaaatcgatcagattctgatggatcgtattgtcgcgcggccattgtctcctccagacagcgacaaggccaaggaacagaactcctctccctttgccactccgaaggcaaggactcggccgactcaccaaccttccgcaacatctctcccgtcccacaagaggcctggaagtgccgttagccagacttctagtatccagagccatcctcctttgcccatggatcatagagaagccatcatggcagccgagaagagatcgttggatcaacgcccctcttctccaagcttgatgggcccgcctcttgccccggcgtctgcctacaggacgaacgtagctcagcgtccacggactcccaacgactccaaccttcaggttggaaccgcaacaacaacgtcacggatgaagatgagacgcgagagccatgtgtcgcggagatcgtcagtgtcatccttcgcttctgagattgaagaacggttcaacgggcatccgaacccagctcttggccctcaaggttatgctgctggtacagatccacgaatgattcaggcaatcacacagactatgattggagagttcttgtggaaatacacccgcaagaccgtgtccggggaaatctccaactcgaggcatcgtcggtacttctggctccacccgtacacccgtacgttgtactggagcgagcaagatccgcaaagtgctggcaagagcgagctccgcacaaagagtgttctgattgaggctgtcagagttgttccagatgacaatccttaccctcccggccttcactgcaagagtcttgaagtagttagcccgggccgccgaatcaggttcactgcgactactagtcagagacacgagacttggttcaatgctctctcatatctgttgttgcgcaactcgacggaaaacggtgaagagcaagagggtgatgcttcgttggaagacatcgatgagtttaaccccggattccgctcacggtcgcgtcagacctcccggctgtcattctcgtcctctcggagtcgtaccagccggaattggcctaagcaacgtgcagggtccatcctgtcaactcgtcgggcggctacccctggtcgtagttccccggcattgagtacgccgtctcattactcggaccagagacacggctcttcctcccgtcttagtacaattctgaacaccacaatcaagggttctttcggtcgaaagggtcctaactatgctacctcgagcatgcatgaaggaagccttcatacacatgatagcgaggaggatctgcggcagatgatggaaaggcaggatgatcggcttgagaatgtgcgagcctgctgcgacggtatgttctttgatccctattgctcagattcggtagtcccaccatcatggcaaccagctgatgaacttcaaacaggcaaacatgatgtcggcgcgctgtcgaggaccagcaaatacagcccccgtgtcaaccgaattcactcccatcattgagaccgtcatcgagaagaatctactgagccgtggcctttaggcctaccgggcaattttatcctctaccctcttcccatggtgttaaacacttgcatgagcctcttttgcattatcattatagtcatattttggcacctcatcatgttcatttggtgtttatgagcgcagaatcagcgtctggatcagcttagccgcgagtttgcatacccctgatgggcacattcctcactaccgccactttctatactctagttctttttaatccctggggcttgacctcatctcccctctcctgtgccccaatcgtttctattgtcattcatttgcgagctgtttcgcacgaaaccatccatatgtttcctttgttgattactcaattgtgagcttaacaataccttgtgaacttgggccactcattacacacttggcttgattgccaactgccaaatttttcattctttttctctacaatctttttcttctctatactaacaagatactgtgcatttacctgtgctggattgcacttgtgtacgatcgaagctgtatttccccctttttttgagctcaaattggttgcgatctgtgatggcgggtttaactttttgtctgaccaattgcatccatccggttagcttcgcatggccaaagtgattggttactatcccatgtcggtttcttgcgtgtctctttactttgggaaattgatctaggttaaccacccttgttgcactgagataattgaagatcgtgtgagattaagggaatccgctagccattcgtagacaaatagatgctatgccacgagtagttttatagtcaaaggacctgcaaagaaaataaattcgaatgatgagaaaaagactagccttatcatgtaccaaataatgccgccatagtagcttaccaacatccttcggaagtcatggacatcatcaatcgtcacttcaattctcaaatatattctcaactataactatctaagggtatcatatcatataataaagaccacaaatatttaccaccagtaagaaaaacgaaggatttaagactaacaagtcttagtcggcttcgcccgcccagccggccaatagtcaaacagatactgagcttcccatgtccacgggccaccggtctctgattcatcttcatggttgttggcattgtcagctgtatccgtcctgctcagagggctgttaccgctctctgaagctcggcgacgatgattatgatgttgttgcggggggagatgacaattgtcgtcgtcgtcgtcgttgttgttgttcaaggtcgtggtcgtgttcatgttgaagcgggtaaaggcagtagggtcggagtgggatttttggagggaggttctgcgctctattccggcttttaggggtggagctactcttggtgtagttgttgtaggaatggcggtggtattgtgttgctgatgcggagggggtgaaggtggagggttatcatcatcatctgatactactatgggatcgtaattgtcgtttctggtatgagatgatggtcagtttggtcttgttcgtcccttggggttctggcatatactgactctggctgtggctgtggctgtggctgttgttggggttctttttcttcttcttgttgttgttgttgttgttgttgctgttgggctaggatggtgtggtacatgagtttcttgcgggagggcttggttttgctggggaggcggaggatgttggctgggggttcgttgttctttggtgattctggttctgggactggttctgggatcggatcttggggttgttcttgggggttgggaagaggaggattggaagcggtttgctttcgctggggtttattgttggaccggtctgtgggtttgagatgggagacggtagaagttgtagtgtggttttttgggtcgcttgtcctggaggatacaccaaaagatgtctctgtccgtctctttgatatctccggtcctggtgctggctctggtccggtcaagtcgatgctcgctggttcacgccgacgggcgacctccgatgcggtctccgtctttttgcgtttcgcaggataatccacctgctcgttctctttcccattcaccggcgttgtatagctttgtctagtacccgtctgaggcgagcctgcgcgctgtgttggggtcttcttgatacccaggagatcgttcagtgaccgggtcggtttctgctgggagggaagagaaggtcgtgcgggagtagaggaattatagacgactgttgtaggggttggcgtccctcctggtcgctgagacggcgagccttggcctttccttttgttactatacaaccccgacagatctgtctccgtcttctccaccggttcgcaaacttcaatcagggccccgttgtccagcttcagttcgtcgccgtcttggatcccttcgtcctgtcgccagtggtggtcgcccacaaagttaccggcgacatcgtataccatgacgcgtttgttgaaggtgtggtatcggaggaagccatcttgccagcgcttggctttgcgtcgcatgtcgtaggtgtagaggcagcggaagcggatcacaggtgcggtgttttgggtcgcagggacgttcatgctcggggtgcttcgtggggtggccattttggtatggagggggaatggtcgagacagaaacagggcccttgatcggtggccctgtgtctgatcaccatctaatgaggaagggatggaacgagtcgtgagattgagattgtttgatcgatgcgcggggaagaagttgtgatactggcggaacgaaccgcggacggggatatctgcctcaggcaagtactgtgttggagcatggctacgttttagttagtcaatctgcattattgattgtttgacgtgcatgtcagcgaatgcattcatgaccgacaagttcccagtttcatcaataatttctatttcgctgcaaaaggggtctgccttggcggtaccacttggttactggagacaattgcgcaattcatcccacgaggtgtccttaataattacgaggaccgcgcggcacaagctataggtagcatgttaaggaggttgccagggatagtagtcagtatactccatctcatacagagacagatcagaattcccacagacaaagtagcaatatctggcatatccttagcgtcagcgtagtgcatcgactagcagaactggtccgttccctggaaatcaaccagggaaatccatccatttgatcctgatcgacaaggcactttcccaccccagaagaaagacattattcgcgacaaaaatagcgttgcgtcagcccatccagccagaaggctgaaacacacttgagaccctctttttttcccttttgctggggaagcagcaacagcagcaaagtagcaaagtagcagcggcccctctggggggctgcgtcatgcgcggctggcttagttctcacgggcaaaatgagtccttttcgagcaatgccacgattccctcttcattccctctcgcttgcttgcttgctggcttgctcgctctctctctctctcccctgcctcgaaactccctttcgatccctttttctcgttccctgaatctccctccctcttcgccaatgaccgtctctccatcctaattccaaattccccgcctgtctgtcccaatctccgcatttctcccttcctccccattccccctccctccactgaggggctctcaattggcacgccatgcagtccatgcaaaggcagtttggccgactcatgaaaaggtcggccgatgacagccaggtggcaattctcctcaaggattttgaagaagcagacaaaatcttgggacgagtaagtatttctatatgtatttttttttttttttttttttttttttttttttttttttttttttttttttttttttttttttctttccccatccaccatgctttagcgtgcacttccctgcggggtgtgatttgttgatatccttccgtatcttgaactgacagcaactcttccgcattccgacagatcatcgattccaccagcgcatggcgcgatgcttggtcgtccctcttgacgcaccaaaatcgaatgctgagcgaattcgaaggtctatatgctcccattctcggttcctccgactcttctgcgccacagcctgccccaactccagaggccaccttggctcggaccaacaagctccgcgagcattatgaagacctccgaaaggatctactgggggacctggctgccatcgatgatcgcatgatccgaccagcgtcgcaagctagggaattcataagcccagtcaagaagaccatcaaaaagcgagatgatcgaaaggtgcgcattatctcgcatggggacctatagtaaccccgttcctggcctcccgctcaggaacccgcccatcaatgcaaccatcccatgctaattctattcttgttctagttggacttcgagcgctaccaagggcgcgtagacagctatgccaaaaagacaaagcgatcagaccgggacaacgcagctcttgccaaggcagagagtgaccttgccaaagcaaccgaggtacgagcccattattccgggcacaattaccatcagtccatctctgtttcgtttctaacgatcgcaggactaccacgcagcggatgaccacttgcgagaatgtctaccacctttgattgccgccgcattctcgctgctccctcgtctgctcgccacgcagattgagatccaaaacaccatgctagccaactactataccgtagtacacaactactgccaggaggcgcaattcccatcgcctgctcccccaatggagcaagtcatccaggaatgggaacgcgaccacctccccgtccagcaagaagtagaggcattcggctgcatcgtcaacggcaaaaccgtgaaaatgtcccaagtccccgaggaatcacgaacctcccgcatcaccagccgtctcccagcaatcaacggatcctcattctcccgtcgcccttcaaacagcgaaacccctccacccaagccgccacggcccacttcaccttctgccacagctacagctacagctttcagcaacaaaaagctccccccaccacccaaaccatcctacgacaccaaaccatccccagtcttcgaaacgaaacctcgattagcctcttcagcttctaacaacaacctcaccatcccctccaactaccatctctccccgcaaccatcctcttccccaggcacagagtcctactactcagcaactgagcacgcccgcactccatccccgggcccctcatcctccgtcgcggcccgcgccgactatttcagtcgaatccagccttcagcaacaccagccagcgccatcagagcaacctcccccggcgttagtgccctagttgccggaaagaagaagcccccgccgccacccccaccgcgggctaactcgagcactgcgctatacgtgacggccctgtatgacttcggaggtcaaagcgcgggggatctggctttccgggagggagatcggatccgtgtcctgaagaagacggatagtacggatgattggtgggagggggagttacgtggggtgaaggggagctttccggctaattatgtggagtgattattgtgatgtcaaagtatatagctgggaggaagtgttgtgttggtaagcgtgaggatggagatggacaaagaggggaagaatgaaagagttgcatgtattccatatattcattcatatttagtagtaatatcttgatatcatttccccttgtgggggagctctagtggttagaaagtgaggtgcaatgtgtatactgtacttgcgttgttattgtgttttatttgtctttaattagtaggggtctcatacatgggagcgagtgaatagaacaatgactcgatatgatgcctatcatacacactatcactagacagctttgtcccatcatctgccacagtcggttttttgctcattcattagagtgtaagtcatggccaaaggataaacgaaaggatacacataacccattctcaccaggacacacggatcctataatgcctggcgtatagttagatgaacgcacccttagatggtgctccgtcggacatttcggtgcccattcgtcgacggcgactttccaggaacatctccaccatacgtttactcgagattggcgagtacatgttctgaagttgactgtccttactagcgacctcttgatacccattctcgagacggacattctcatcagtcaatcttctattctcttgaggcacacgtgaagacctgatttgggaggccttcgaatcctgggcttctggaagcaacctggaaggctgtctcccgtatcttctaccccctgctctccaccgcgctttatccgttgcatctctccttggagttggagactctggagcccgatatctattattcaatagtgcaggtaccggcgacaaagccataccatcgggccgtgtctccacctggttaatgaacaagctacgcccactagagctgcttaataccttgggggtcgagtcggacggcggcggaggaggaaccagagtgtctgcttgctcctttggggcaatgactgttgtgcgtacacttgacgatcggctgaacggacgtgagaagttatttctggctgttactttgcaagttgtccgcagatcttcatctggcgatccactccagaagcctcgtctgtctcgagatggggttcgataagcaagatccgctgtttcgtcttggatttgggcatcttctcgatagtgacgcctggtgggtgtaagatattcaatccgctccatttgggtgcgcacccattgctgccaatccgcactcggtcgttgcatcgcctcgggaccctggtcagcattacgctttggcgaactatagatcgcccgctgacttgcgtatatggtagccacacctggctcattcgcaacttcaggatcactctcacccattttcgggtccgttgttttaggcgaggttccgccagtggagcgagaatacatacttggggaatcctcgtcttcctctgggctttgagatcttcccatagccatgtttccggtctcgtctctagaatcctccttgatagtgtgtttagacgatgccagattggcagaaccaaaacgaatgtcctgcaggtgcttttggccgtgggtacgctgagcctggcgctgggctggctcgcagggagtgactgtgcccacatcagctgttgtatatgagcctgggctctggagtgactcatcgctggcgatcaaacgaattgtcttcctactgcggcgagtgtacattgaggacacaggtgtcggaatcgcgcgatgttccctgacatggccaaggacaatttctttgcttgcattctccgtcttgttcccatcaatgcgtttcatcagcgcagaatacaagcgctgactgtctatcgtacagttaggctttggagtgcgacaagtggtcagtgaaacgtcttcagatgagcttggcttaagacaggaactgtcatgttcgtctataacagacaaagagctgtggtcgtctgctctatatgttataacagtgtttgctatcgtcgagtccgcccagcttgttacgcgagagcggcttgtggcaaggctctcggagctctcggattttttgactcctgtataaaccacggttccctcggtatctggtgagtgtgtcaaggcatttccctcgactccagagtttaagggatcagagtgctttgcagatatggtcgagggcgacccctgtattcgttgctggtcatttgaagaagatttccctagagatatacgggccgaggaaggcctggagagctccaacaccttcttgagtcctttcttgagggacgatgacagtgatctggctttaccgtaggatatgacgttcgtggatcgctgtattgccggcgacacgcttgcagactctgcgtctgacaccactgaacgaagtgtttttttaaaaggccttgatttagggactgttagtgatgatttcctgagctcagtcggatagatttccggctgctggtagtgacttcgtgccatttcaatcgctacgtcctgacccctagcatatcgtagagaatcagaattttgggtatctccccggaagaatgacatggaacgcctcagggtgccaggagctcggagaacatcctgtggttctctccttgtcaatatgttatgggtaggacatccaggcgaggacagcccacgaggtacatgggaagagcgctgccaattcgtgaacatcgatcgggtcttgcggagtcgccgataggaagaaggcaaagtagcgattccggcatcgagccttccaaactccctgatagacggtagaccagctggcggagatagatcgctcgtcttgtcgagcacagaccgacgaagatctacatcctcaaccggagcatttgtagcatttagtgcagcacctgcaggtcgatgttgcctctgaggcactgccattttgcttggacccccgagaacatcataggagcacttggatcgcagcatggctcgagacgcagctgtggtagcttgaaacctagccagctctgggtcgaagggctccgtcgattgggagctgtgatggcttcttctcatggaccgagacgattgcgatcttcgcaggggttccatggtgtggatacaggaccaacgaagggactatttttgtgaatggggagactgtattcggtgatggaagtatgaaaggtagatgatagaaacgtaaaggtaatgctttcatctgcagcagtcatctgagaagacgagtatccatgtcgatagagcagaaggaaggcacgggttcctgctaaaagtgtacacgttggttgcacttgcaccttccctgtcattaccatcacaattacagcccgatgttaatagttctacagtgagatgcaatggctgctgtaggaggcttaggagagttataatctcgaagcctctccctataggatatatccatagcaagaccgagggacgacatggttgccacctatagtgtagacctgggaaatcagtatattccgtcagttcagtccctttactagtttcataacaaagtataaaactatgcctggcttttggtaatcaatgccatcgagtagcacatagcatacagctacatgtaggtacttgtttccattcagaactgtttcttcccctgcctgtactaaccacccgagtgaggtaccgtatgtgatgttcctggaggtaccagtagataatcgcctggaccatccggtcatactacttacttagtaccgggcagaatactactcagttgtcattggtggagttgaacccgcgatcgattcaatcatagagagagaagatcgtagtatcactcgtagattatgtggtctaacttagtagcaactacataatcaccatcatgttacctttacgtggaaaaatatatatctagtacacaccatggatgtctcggtaacagagataccaagacaccactaactacgggatagtagtagataactaatctatcaaaaagaatagtaagatcggatgcaaaagccgagccacatcaatttaactatcaacagcaacaaagaccggcacggaatccctatcgtagccgagggaggggagaggagccgccaatcttcccgcgccaggatgatgatgacgatgacgacgccacacccttatccaacccacctacccatccagattaatccagtaggcaagggacgcgttattcttcatttcgggaaggctggggccggcatacgtcagtcagtcaatcacagtctgttcgagtcaccgtgcacacatccaccgacaggcgtaatgagcgacacatgatgtggtagggaactaagtaggtaactaagtagctaattacttcgaacttggtgataagtagaagaatggaaagtatgacagcccggcacatgtaagccgggaagcgatgacatccgggatccgcgctctgcaggggtctggcccccaaagccctcaagccctccttctccttcctctccagatgtcacatcgaagaagaggggaaaggcaacaaaaaatagaaaaagcaagaaccaaggatcgacaacggtctgcaggcattacttactacatgcccggagtccggagttgtgaaggaggagtaaagtgaacggttcactagtgtcagccgatcatcctattacttaggagttctttcattgcctgtttgctttttcccttcttccttcgcggtaactaaagaagagcaaaattgaatgaaataagaaagaaacttgagtacctagggcaaatgcattattcgattttttgttttgaatgaggataataaatcgtacaattagccgaatgggtatggaaatcgaccaacgatattacagagcacacatgacatgacaaagaaaatggtacacggaggtgtgggaaccagacaaagacggtatcgaaagcgaggaaggagaagaaaggaagagggaaaagaagaatagaagaatgaccgggcgagagaaagagaaagagatccagcctgcaccccctgcgtccactgttgaatgattcccagcggtgtgtgcgcgttcctgctgtcggcgattctggactgtcaagtcaaggcagctcgctgtctctctcttcctctctcttctctcaccatcggtcccttccgggcaatccacccagtagcccattaataaaatatagataaccaaaatgccgttcctgtgattaaataaaaagcaaacccacatgtacaccagcctactcgaccgcgcccccacccttcccgcgctatgcagttgcctggcgaaaaaaaagacggggaagaatggagggcgagagtggaacagtgccagaccgccaggataaataaaatcgataaagccgcccttccatggtataatagatgatcgattaaactcccagcaatgcatcaagtcagagagcatcaagccgcatatggtaagcgagaagcgaagcgaagaggaggcgagataggctcaaaaattccctgggttcggtcccagccggcaggacccctggaaatctgcagtgatcttgtgggatctctgcacccgtcctattttaaagcgccatgggatcgtagccgtgtcgtcatagggagcgctcgatctccttgaatggtgaatcgttgaggatctccgatggaagggctctccggtagtctcggggctgggcaaagggagatgatgaaagaggccgacgcagcttcaattgctgtgattctccatgttagtgttgggtgtctcgtagaatgcgagtgaaatgccgaggtccggtttagggctgacgacttaccacacagtcagagcatttacctccctggatgttgacgcgaccgcggcaaccgcgaggataattggcgcaagagaacatggcgaatttttttgtgggggggaaagttgagaaatgcgcaggtgttttggtggcagtcgtggttcgagtgaagaagataaatcccgtcaagggagcttttctagggctgaggcttgctgtctcggagcggagcaggaaggggaaaaagtacaataaaaaaaaaagaagtgtcaaaagcaccggagacaatgaatagtaatgaaggagagacagaggggagggttaaaaaaaaattcaaaatagccccaatcgcaagccacggggcaattacgtcaagatcgcaaggccgttgtcttgcagcggcaccagcagggggagcgaaaaaaaggaagcgtatttaggcgcaccggccggggtccgttgaggttctagcgctgaggttaggctgcgccactaaagtgggtggtggatggggcgaagagagacacaaaagtgcaacagcgtgcagcagttgactagcaaaaggaatgaatgtcaaaaggagtgcagggcagataaatcgatcgatcaacggtcaattatcacacggagggaaatgggatggaacgtcgagggaacctaagaggaaaaggaggtaaatttgagggatctcagatttatatcagtaatggagatctatgcgaaacggcttccaggaagatcggggtaaagggtcgtcgaagaacgggtgagtattagtgataataaattcggaaagagagaaaaaaaaaaatcgtcaaataatataacaagctatgcaaatgatcgtaataggcaaaatcaaatattaattttggggtaccatggcatccaacgggccacgggacggggcaagatggagcccgtgtgtatattgttctgatgcagccctcgaattggaaccagacttgtctagatacccgactgtgtatggtcaatgattactaccttgtggtgctggtgacaatggtggcgatgatggatactaataaacaaatcatacacgccgggaatcaccatcatctatcccagcattcgtaatttgagtgtaccacagtgccagccttcgcttgtcatcctgggcatcaccgagtgctggccttggcatagattattttgctccctgtgatgtcgatggactcccaacgggccattggttcttcgaatgcccaacagtggactctgtgtctcccggctggctgctcgaaggtgatccaaaatggggaatagggaggggggcaaaagagcgaaggggaaagggaagaaaaaatttttctttcttttattttatttttttattttcccttttcttgttcccgaacctaccatacagtctgcccccatgtaacagcctgatcgcccatatgactcgcagttatggcccctgggtgggtggaggatggatgacttgattgcagggcggcgtgggccctgtcaaaaaagtgattttcacgactcaaccatgcatcgcagtgcagctggtgttgttgacctggtcgcttaagatagagaagcagataataattgggagacccactggtaccaacagccggcatcgtagcagcccatggagtttcgaatagatgagggtaatagagccgtagcagcagagtctggatcttgggcccgaaccgtcgcaccaagaaagtttccacagtttctggaacgtcgactgagcttcttctccttttctctgtgtgtttcccttctctccccctttgcccctttcggagttggccccctcttctctcagtctcaccccttttgccctctttagtgcgcagtcagctgtcggaagacacgggtgaagtgaccaatgaaaggacggttttactgtctggtctttgttctcaccctggcattgccttgatccatggcattcattgttacttcaatcgggtgagtcagaagacaacctgagtagagtctggatgacaccgaacggcctccgcttcttccctggtcgcatccttgtcttccgttgtgttacctctgttgatcatccctcaattgccttgttttgtgatgatcattattgcttttccaatacattctgcctgttcgcctctcttattcggacctcttattatttttttttccaggtttagttaaaaggtagtctcggtaagagtcaagtgggagtcactaggttccgcaccgccgggttggcaaaagtggggggaggcctgattgatgcctgccgcaaagccgtgaacggtaaatccgtaaagcctggctttcccacagcctagctgaggcagggcattatttgtctcagaagcagccagccggttcagttcagcagtctagtgcaaaaggaatacgatccgcaattcagcctcgtccatggccatcggggtcaggatccgtccagcatgtgctgctttgatccagtagtggacaaggtgaagctggcagacccaagggaatcctgtcaggtgagcctgggttgttcccaggcttccgcaattggtccgcctgcgtagaaatgccgtgcccagccatcggtttcagcgaacctgacagtaggtaatcacaacgagcgccagagagttctgttccagggccgacccagacatcccgggccggagggtccagacctggaccatcattgtgcggtacggccgagggctggtgcatggctgagcacggcatccatcgatgtggaaagtaagacgcgggagggatgaattgtatgaggaggggaagatggaagcatcgggaaacttgatctatagtggtcacttgacctgcaaaggatcatgtgcttgtacgctacacggatggtcgcattggctatctctactttcgtacagagagtagtaggtactagaatgttgctctagattcaccctatacttccaattgggtattggtgactactcggtgatgctctacttaccactgcctcaattttgtgcactcggtaggacgaaccggatcttaacggagtaccatcaactccgttgaccgtgatatactactaatcaataattctatgacccggtgtgtacttgcatgtgtctgtccttcctgccgccatccggcaagtaaaaggtcaatccaatatctcacacaatcaaatgatagtggtgaacagtgccatcactttcctgccggggccgaagcatagttttggcgaagcccgtgataattcgttcgatttctatactatagagttgacccaactaattactatcccagacccagaccatgaaatcaccgtatgataatactaactcagtgtagacatctccagcagcaaattaccgtccattaattcccattaatgagtagcaaattaccacccattcaatatattaaaccttgcagcttagattaatatcaagtgtatattaaaacccagcatcgtcaccatcttcatcatcaccagactaccaatatgccgctgtaaccgaattcggtcagacaacgctgtgcgtcggacactaaatggtttcaccagtgagtaaaagagcggaccctctctcttcctcccactcagaaatgcatccattccttaccatcactaactagtaaccaaatagtacgcaggaaaaaccctttctttagcgtccttattggtggtctcacctgcttcgcttccatggagcgggcagcccgtccatccctctcattagctattttgcctttcgcccttgtttctccattgccttaattacctcgggactggcccgcttttgcaaaaattccgcccttctaattaaatattatgtattagatatttatctatctatctagcgatcaatctattttatataaccgaagcaggtcttcagcttggccttgatgatcgcccaaccgtgcaatgctcccactttgcctggacggcaagccatcgactagtagacgagtctggatgcctgcccatctggaaggaatcaatacccactgactgggtcgcaaggctaggtacgacccaagcccgtcagacggtcagtgacccgatctaaccggggccaaactttcttctgtaacggctccatcgtctccaggcactactaggttgtgtcgccggctcgaatttgggaatcccagaacggaatcccaaagcagaggaagcatgcagcgtggcttatacatctcgcaactatttaccaacccccgcccagaaatccttcactcctttggaagaaattgggtgtctagattgtcgatctgctttgagcctcttcgtccgcgccggtccttctctttccgtgttccttgggcttcgttcccgaccgttctagatccggctcccagtcagctgacccggtgcagaggcaaacccaatgttatagcttgctgggtcccactgcacgtatggatccaatacgatgtcgccttgaatgcggtgtcgccgtcccagatggacgaggatgtgagttatcttgcgccgaacgaccttgtggccatattattcagcggcggtcaaaaatgttaccatcatttgatggtgaaacccgaaatagcccatgaagatccaggaaaatcacccgttcgtattgactttgcgtctgctaccggagatcgggacgatccacatggggcacagtttcaggaaaactccgcagagctgcagctctgcaacgcatcttcaaacgttaaagaacgatcggagcacgagccacgcccccagaagtcctacagccgatgcaagtaacagcccgtttccttcccaggtcaaggccaggtacgccaaaaagcccaccgcaagttccttccttcgcgcggcatctcgtttagtctcccattctggatcgatcgggaaagggacagccgtctgtgtcgcatcttctaggcgcacggactgtgccggtatagatacggccaaggcgacggcgcgatggtcggatgttgggaataacggcaaagcatcatacttcagaggtttgacctgacctctcttgcttgtgcccggtggagaatccagatacaacacacggtcgcaccaactgggccagcgggtcctcgtccacttccaatctgggcgtgcattatctgccattggatcacttgctgcctggcgtgccgccaacgtatacttgtatgttggggggaatgtgatcggggcttcggagagtccgtggaaacaccgagactgttccatctcgcgggaaagctgatcttgtttcaagagatgtgagtagtgctgagggtccgaagggtctacatccgctcgcgggaatcggctatggtcgtctggtcgcggcgatacgttggaggtacggtaattgaggtcacccgctaggaagaggtagcttgtaggcgtgtagatgccccgatggccttcttgggattgccgcagcaggggcgcattttcctccgcgttggctgtgtcggggatttcccgacctgcagcaggtgagtagctgaagaccaaccgctcgaccaagctgcgccagtcttcattcctctgctcgacagcgtgctccatgggggcgaggtgcgcagcagcaaaagtgaggtccaaaggatccccggctgatgctgcgcctctgtaggctatccgtgcgcccacggcacccttattccccatctgttggacgccaaaccctacacgggcggtgtcaatggatgagacttggtcagcgacatccgaccgagcaaagaccatcagaccggtcatcccggaattgtcggtgaccaggttgacgtaatggacatcccagtactgggcaactgcgcgatccaccacctgtgtcagagctgagaagtatggcgttaggaacgagcctccgagaaaggcataggcgataggagctatttcctgcagggagagcacgatgaactccggggctgcaggcgagctggaaccctcggtgcggggtaaggcatcgaagaaatggcgggagaagcggtcgacgtcgacggggtttcgagcgcaattgaaggtgaggatatagagtaagagcgaatccattgtgtgggcgtgtttcagtggggttggtcttgtttcatgagatgtccaagagtgaacaaagaaggccgactgtataatgcgaaatgagagaaagcaaaggttgagattgagagatcttgcagagctggtgaggtggacatgtgacgatcagtggatccgttgccggggaatgagatcatctgctacatcgaactatcaccaccctcatcaccgccaccaaacactgcgcaacataatggcgacaatgaatactctgtatattccttgaacattgtctgagagacttatatagtatttttgcgtcatatccgaacccttacttgacgcctgctggctccagtaacacttcccgcactgtttatcctagagcttcccttgcaacccgtcagtcaactccaccaacagcatcccttctgccacatcctcttcttcatcttccatctcatatacccattgtgcttgccctgcgcgcggactgcgcacctccacctccatcttcatctgctttataaacgctatcacctgattttcagctacatgatcccccgaagacacaagcacttcaattaactttccagataaaggaaggacaatgtgtcgtgggttacttaagtctccgcgtctatgagcggatgaaaagagggcagatgctgtggtcgaggtggcagccagttctagtcgataggcaccggaagaactgggcgtctgatactcgatatcggctgcaagcgaagtcggaaagtcattccgcagcacgcgtgtgagttggaggcgatgttgctgtgactgctgagatgcctccactggcgtgagtctgattgaccatgcatctcctcgtcgaaatagaagattcgaagaaggcacactaggcaacgcagtgggacgctgtccctgcacaggtccctgagtacgaactgatcgtgagacacttgctccctgctggagcacttggtccagactggactccagccattgtgtgtctatccttccagaaaggaagtcttcctgagcaacaacccctctcagcaattccaagttagtccggacaccagccactgtagtgtctgcaagcactcgccgggctttgaggactgctccctcccaagtagatgcagtgacaatgattttagcgagtagattgtccaactgcgcccctaccacaacagggttcgccccagcagcacgaatatgggtatcaactctcacaccacggccactcggaacaaccatctcagttaccttccctacactcagggcaaactgattgctcggatcttccgcacacaaccggagctgaatagcacaagccttaggagtatccaaccccacatccccaagcccaagctgtgcaaacgtataccccatcgccagttttaactgagcctgcacaagatccaccctcataagctcttcagtaaccgtatgttcaacctgtattctggggttaatctccaagaaataaaactccccactcccctcattcaccaaaaactccaccgtccccagcgacctataccttgtagccctccccatcctcacagcagcatccaccaccctctgcactagcccccgatccccaatcaatgacggcgccatctcaaccaccttctgaaaccgcctctgtacactgcaatccctttcccacagatgcctcacctccaccccgtccccaataatctgcacctctacatgtcgaaaccccttcacagccgccttttccacaaacaccatccccgacggcgactcgttaacagcacccctcaccgcaccctccaacccctcatccccatacacaagccgaatcccccggcccccacccccatccacggccttcaccataacaggatactgcacctgcttcacaaatgcccgcacctccgcaacatctgccgtcggctgcgccatcgccggcaagacgggaacgtcgcactccacggctagttgcttcgcttggagcttgtctcccgtgcgagataatactgagctgccgggccctattacggtgattccggcgtcttgcatgcgggcagcgaagtccgcgctttcgcttaggaagccgtagcctgggtgaatggcgtcgatggcattgtcctgagctagacgcactaggaagggactgtcgaggtaggttgccactgatgggatgaggagagcatgatccgggtgggctgtgtcgcagtgcgaggtgtcatcctcggtatagatagcgtatacttctatgggtggggagagctcgcgagcggcttgaatgatgcggacggcgatttcacctctgtttcattgtcagtttatgaggtcaatgtggagattgggcgatggcgtacctgttggcgactagaagtcgtcggaagggttcagacgatgtcattatagtatggtatcttgttgtgaaaggtgtatggtttcgaatgcatagatagataaatgggattgacttctgtatgtatgtatggatgatggggttggttgcattcctcggacctcggaattaagagacgttgcgctcatagatattgagcttacccctcatgagggacaacccgctgcagtaacatgcaaggggaatctgcaattgaaaataggctcaacaaccgcacactatgacatgaatagagcataattaatctaatcgaaccacatcatgtccgacaataacgacaaaaaccccaaagacgatgcgcagtcacgacaagcaaccaaacgactccgccaactctcctcacacctacctcccgactactccgacgtcctctcccacatcaacactctccgcacactagcctccacccccgactcatctcgcagaggctatatccgtcaaaagcaagccgggaagctatgggttcgcgagcgcctcgaacaactcctagatcccgatagtttccaagaaatcggctcgctctcgggcactgtaacatgggagaaaacaggacctatgcgcgagaagcccgtttcttttaccccgagtaataatgtccaaggggcggggaaattgcgtggtcgaaggattcttctaacagcggatgatttcactctccggagtggacatgcggatggagcttcgcatggtaaaacgatctatctggagaagctggcattggcgctgaggttgccggttgtcaagttggtggatgggagctctgggggaggcagtgttactactattcgcacggctggttggagttatttgccgtatgtgtcaatgtataggcacgtcgttgagcaactgaatcaggggattccgaatttgggggctgtggtggggccggctgtatgtatccaatccatcatcattcaccttcgagtgttcggatgtttcagctgacagtatagatcggactgggagctgcgcgagtagtgtcctgccatttctccgtcatggcagcggatgttggatcgctcttcaacgcaggcccagaagtagtcaagggagccacgtttgaggaaggtctggactttcaaactctaggtggcccaatgattcactgcacgaatggaaccatcgacaatctagccgccaatgaagctgagtgttacgagcagctgcgcaccgtactgagctatttgcccaacactggccgggaggcaccgccagtcattgccgctgatgatccagaagaccgcgaggatgagtcgctgcgccggattatccctcggcggcagacgcgcatgtacaatccgtggactattatcaccagcgtcgtggataagggatcatggttcgagattggtgcgctctggggtcgcactgctatcgggggtctggcgcgcctgggagggcggccggtgggtgtgatatcgctcaactgtgaggtgaacgggggagctctggatgcagccgggagccagaagcttgcgcggttactgaagctctgtgatgtgatgaatctgccggttttgcagtttattgacgttcgtaagtgatacggtctgtactccccttccaagacactctccgctgatgatatacgatgtagcgggctatgctatcggcaccgttgcagaacgaaccgccactatgcgctggggagtagaattaggcaagacgtatttcactacgacgattcccttattcaatgtaattacgcgacgagcctatggcgtggctggaggtcttatgctcggagcgcgcgacccggtcatgcaagtcgcttggccgtccggtcaatgggggtcattaccgttggaaggcgggattgaggtcgcacatcgccacgagctgcgcgaggcagagaaagtaggacagaaggaagcccggtataaggagctagaagaggagtatcgaaggctgatgaacccggtgcggacggcgaatgcgtttggcgttgaggagatcattgaccccaaggatactcggcgggtgtgttgcgcatgggcgcagcatgtatatgaggttatgatcccggagaggctggccgaccgtgcagcaggaaagattcaaccggtttttatgtaggctgctatgggtctgcatttgctgtgtcaggtggtgaagaacctgaagatagtatggccatttattacgctagcagtacctccatggtatgtagacaggagatacagtatataactgagaccaccaagagcacacaaattaagatactcaatataacgagattatcctcttgtccctagaaacccccactaggcgttcatttcggttaaatccgatggtgtctgacagacaagtggggagcaagcaaagcaatcagtccctgagggggtcgcccggaggttcggaaattaaatcaatttcaggtccattagggactgactgtctgctgcctgtttaaataaaccgatgcaagacaagaagatcctgaaaatgtagctgtcggaaaaatacctcacaaactaacgctcaaccaacaagtacacaaaccatgaacttcaccatcgtcaacggccaaatctacaccccaggcctagccataatcgatgctccacagccctatactcccctcggaggaggtacgtccaaccattatccatccatcttacccaacccaccaacactaaaataaataaaaaaatcagataccctccaagtcgccatcgacacctccggcgacggccaactctccaccacatccaccaccaccaaatttcacaccctcaccctcttcctaacctccacaacgacccacaaaaacctcaccatctccaacggcaccactcccagcagcaacaacacctacgtggggcccgtgctggacctcgagccctcgtccaccgtcaagcacgtgaactggatctggccggcatgttttgtgggcagcggcggggataaggcaccccggggtgactataatgtctccgtgcatcagagtttccggtgggaagggacagattattatacggtgtttgagttgccgatttcggtgacgaatgcgattgatgagagtgaggagagagtggactgtggggttttggagaatgagtgggtggggtgggagcagttgagggagagtaacgattctttgccggggcagccttgggtgaatgagagtcaagtgagtgggagtgggagtggaagcgggagtgggggggatgagagtagtgggagtatggggagtagggggtatagagctggggttatggggtgggttgtgttggggttgattatgggggttgtgatgggttgatcgttttggtgtataatagtaatggtaatagttttcaggttgtctgtagtattgtttctgttgattcagatctcatgttgtacctgtcggggtagctttgatacttcacgtgataaattgttatttcttgattaatcaaacaggtagatagctctcaaactccgatccaaattgaacgctcatcatcaaagataggaaggacactaggcaatctccggcccagtatacatacagcagactcatcgtggcggtcgtgaacatttgaccgaaagtgttaagacagaaagagaagatagaagtaaaccagagggaggggagtggagaaaatgaagcccctgcaggactcatcatgcacaccacattcgacacccagttggtccaaattaaatggaaggccgacggtcgccccaaagcccaacgatacccatggcgagggcaatgccagagaagacagcccgcacctgctggaatcgacgctccgtgttcatctccttctgtacactttcaccattgacattctcctctgcctcgaccaccacgatatcctcttctttcttttgcttctggacggtcaggaatccgcatccggtgtcctgcagaacagactgaatccaggccacgaaaccatcctggcggtggaacaaatagtcgaaagcataagagccaacggtggaggtgacacacacccagatgagatatgggtgcttgcgctgtctagaagagaggcaatacgcgaacaggaaacatccgttggcaatgttggtcagtcgcagaccatgcttacggttcaaccgcttgacttcattgagagaccgggaggcagtgctggcagtcggaagaagactcagggaggggatggcgacgctggaagcggagtatgacatgccctagaggtgatagattgcgcgtcagttggcggctggtcagattttacgaggactagctgacgaagtctcagagatcttcgcaacacaaataatccaagcaggttatagagatcgtaccgtgagcagccccagggacactgtgcccacgaacttcgagacggtgatgggacacgccatgattatgcaacaggaacgctgccactagaggggagctggttgtgaaagcttcttttcacccgaggaggacgtaatatcacttctcgatgcgtctgaaagaacgattcgttgattggaggcgtggtgcgcttagaacttcaaggcgggtgcaaagataaggccatagaaaagttcgcgatggcagatggagtgacgttgttgcatgcctgaggctagcgcagtccagtcagccaatcaccagctcgctgttaaattccgagaagcatttgcaactaggcctattccggttagctcttcgagctcatgtctttcatgaaactaagcctaaaggagacaccaagagtggatccatcgaagacaaactttccgcatatagtttagaccagattagtattccaaacccagaagccgaggcttggactcggagtaaccgtcgggttgcggagattccattcaacggccatcccggagtccttcctctatatcaactatcagggtaaccttgacaattgcaccagacaagaccgttctttacttccatactgtatatacactatactgatatcctttaaaatgcccctccccaaagaatcctatctaagtaacacgtggaaggatggcctgttcagtaagtcggcttatggcggtcaccacatgctccggcggtcactgacagccaacagccaacaaggttgtcttctgcacaggaggcgcaggaaccatttgcagtgcgcaggttcgtgctctggttcatctaggtgccgacgcttgcattatcggtagaaatgtcgaaaagaccgagaaagcagcccaggacattgcaaccgctcgtcctggcgccaaggtcattggcattggtgcagtggatgtacgaaaattggagagtcttcaagctgcggcggaccgctgtgtcaaggagctgggtggcatagactatgtcatgtgtgtatcacatcgtcctggctagttctctactaatctgggctataactgtcaagtgctggagcagccgggaactttctagcctcgatcaaccagctgtcagcgaatgctttcaaatcggtcattgacatcgacgttttgggatcctacaacacgctcaaagctactattccataccttgttgagtcggccaagaagcacagagtggactccgaaactcgtaagtggacagtatcgcgaatagtcgcgacaagcgctaacgtcataccatcatcagtcaaaccctctgcagcaggcactggagggcgcatcatctttgttagtgccactctccactatcggacggcacctttccagacgcacgtctcagtcgccaaggcaggcgtcgatgcgctgtctcacagtgtggctatcgagtttggccctctgggcgtcacttctaatatcattgcacccggacccattgcttcgacagaggtttgtctttgtcccgcatatcatatgaatatgcacatctgactcaagattatagggcctcgatcgcctccttcccagtgatacgaaggacgcttacatcaagtcgcagcccctaggccgagtcggctctgtacgcgatatttcggatgccaccgtttatctttttgcggacactggcagctacgtcagtggccaaactttagtgggtgagtctcgtacttttcaaatttataatagataatgtattaacacaatatagtggatggtgcatcctggcggatgtctgccactggggcaaccttcgggaaacttgcgtatcccgatttccttctttctggcgacgccgtccccaacgtcaaaggccagaagaagtccaagctgtagaggcgtgttttcatgtttctgtacagggtagaaaatgtcttgggtatttatatctcatagagggtactttttgttccttgagttagctcatactacgcttagataaagaagcctttatgagagggacaaaggcacagttcaattctcggtgtgctctgactcttttagtacttagattctatgtttcatcaggataaataacaaagactatatacaatttcaggacaatgccttggttcagaatctttcagcgcaatcaataagaaccgaacagctgaaaaagtgcctaacgcagaaatcgaacgatcatgggcttatttattagtgtgccggtagcctacattgctgtccaagacaaataaaagattgaaaagcgatctactaccttctgtatcgttaaatccccaacgagattgcgccctcgaataaatagaatcacatccgacataagcgaagacacttttacttccggataataaatcagcatcaaatactccccttactctcaactccgcatatctagcaacatgtcaggcagacgaccacccaaccaacggaggatacctttcggagcacataagcagataacagctcccgaaaacgatccggaagaatggccgcaggacgatgacaatttaacccagcaactcacagaagcacaacacaaggccttagagctcgacagggagaacaagcagctaacaagccaagtccatgatctgaatcaggtgcttgttgagcgagaacaggccttcgcgcaatcagagcaagagctgcgacggacccaaagggatctaaaagccgttgaaatccaaattaagaagaacgaggagcatgtacaagccgcagagagcgcaaatactatgcttaatgcgaaaaataatgcgcaggctgagcagatccgtcgcattcgccaagactataagaagctcaaggaagaagagacatcccgcagtggtgagattgaaaaattgcagcagcagatacttgacgcgagtcgagaattgaatgaaatcaagcagaagcttgacttaaaggaatcagaattggcagcgcaaaaactggagatggggcagcttgctaagacagtaaataaatacaaagggaacgatactgagttaaggaagcaattaaacaggcttgcggagcaggtgcatacaattgaacctgcgatggcactagatactgttgcacagcctacaagtgcgatgaataccgcactgattccttctgcccagaacaagctgattacgcataaccccttcggcttcagcctccagaatccatctctaacactgaggcaggaattgggaggtagcttatatagtggatcgcaaagtgctgcaagtagcggagctctgtcaccagtggaccagagaggcagcataagcagcaagttcagcgctccagtgatccctgctcagaatcagaaaccatctattgaggcggttcctgtagactggagcaatatccagcaggcagctaaaaccggtgcgataccgcatgtgggacaagcccttgtccctagcaccagtttaaagcgaccttttgctggattggaagccttgcagggctttgatggttcggaagaggcgatcaaaaagctgcgtgttgctgctgatcagcaaaagcttgggtccaacccagacaactcatttttggctgttttccagaagtacttgcagacgttgcaggaggcgactaatcagaaccatagtcagcaagaacaactggacgtcttcaagagaactgtccaagccctgaccgcgcaaggcaatacaagctttggaaatcaattttcgaactctcagagcagctggattcaagattatcagaaggctgctgcacaggcagcgaatgatccttcaaaggctcagcccaaggctatagtcactggcgttaaacagccaaaagggtcaaagcccaaagaaaagccgaaaaaattcctgacacgtacgccgaattatcaatggccagtatatctggaaaagagatataacccgtcgactccattgacggtgccaccctttcgaacgacacgaaagaagtttgccaacttttcagtccctggtgcatatgaagatgatcagactgagagcacaggatcggagtcaaagttagagtttgaaactgcgccggagtacttcgaaactcaggtcagtgccccagagcaagtaccgatgccacccgctgtcataatggcacggtgggctttagtcttgctgggagtttttatagttgtgacggctatggttgaaaatttattcggacggacgaatgaaacgcaggatatctggatgcaatataatgaggtacctgagggtgtcttggctaaagtccgtggcagcaaaccccctgttgtagggtcgatgcagggcttggattacgagtttgccaaattcgtcgatatcagatcgcgcctggtgggatgaggaaagtttccatggtcggtgaacccggtctgctggtatggagcgggtatacagttatatttcagaattttctatctatgtctcgtgtctgttctaccatatacatgatagctgatgtgtacaaagtacttgttgtgatgatcaaccaccatgaaataaatgggattcaaggctattttaggaaatccagagcacgtgatggacattttgcagtggatgcgtcagctgctccaaaagaagcaggcggtgaggatctcatgcgtcacctgctccacccgcgcgccatcaacagccaatcaggaaagaaatcgaacgatgcgcgattcgccttttgaaccccctcctggctggctatgcaagaagtgctcgctggtggaatccatatcatcaaagcattccccccatcatctgtttcttatttttacggctgaatatcatccgtttttcatctcaagaactcttcttcccatcacgaaacgtatcttcattccaccgttcttactctatagcgcctcttcacccgtcttatcggtgcctggcttagatccgcctcggccaccatgcacctccgttcgtgccttgtggggagcgttctcgctctcggcgccaacgccttccttgttatccccgaagtcgaagaagccatcgcccctgagggtgacttccctcccctccaccctttggaggtttatgctcccaagaaggaacaggttgagcttgcctgcaccgaatgtccgttccgtgaagtcagtgaggatgggaaggtcagctggactgacggtttccagacctctttggtaagtagttccgagccgatgtctagtacgacttgggacaggtgaagggacttggatgctaacagtcgcttcagttggtcgacttctccactgaaaatggcttccttctggccaacggtcgccaaatcttccctccgccacctcccactctcatcactgccgttcagagccggacgtcggatggcgtagagacggaacccattccgttgggatatgctgtggaggaaatgcctttgcccactccgcctgaggaccctatggatttggtcgctgtgcgcttcactgtcctcgatctcgacagtcgccccgtccccttggatacggtggctttgactcttctccatgaccctagcagcggcgagctgtacatcgccaagactgagatcgaagaagcgacccccgaccgcgtctcctggaaacaatgccgcggaaagccgaagtgtctcaggaagctcttgttcgaccgcatgcgcgccttgttcgctgcggccaaggcccgcatgcttggaatgggacctaagccgaagggctcgcactgcggtggtcctcacggcttggacttccctcctccgccccgccctcaccatcaccatcaccaccatcccgatgacaagttcgaccctgagcgcatgccgcccatgccgcccatggagggagaggaggctgaattccatggccatatggacaagtttgaccgcccccaccatcaccaccacatgcaccacatgcaccatggcaagtgggaacgcaccgtccaccgcgtggtccgtttcatcgtggttcccgctgtgctgggtgttttggcaggtctggccgcgagcgctcttggtatgctggtcggccagatcgtggtcttcatgtggcaacgtttccgccgctctactcccaagaagtccttggaacagggtacggtatctgaaaagcagggtctgatgatggagtccgaagaactcccaccggcatacagtgatgaagaggccgtggttgaggaagtatcttcggctaagaactgattcgatccacaataatagtacttgctctcctttgcctcttccgaccgcaaatcaagatactgcactgcccttgacctttcctatcaaaatatggatttgaccaaatattcgggcactactatgaaaaaaaatacatttcccggatttttgttgtttcattcaatgtgtttctataaagcgaactctcgtttcaatttcctttcctctcaaaatttcttttcaaacttcgtccatcgtgttctgcagggatttatagttcactctcggcttttccctgtcggctgtaccaagctactagtcagactccactagtttctttatgtagttccaatatggttataagttgttccgtagcgaaagcacttatgcaccatgcatcaccagtaacacctaaagcaggggttcacgtagctgcactggggctgcctcgtggtgtttcagagcaagacaaatccctgtcacgtgaggatattcacggccacctgccaggaacggccgccgccaaccttcccctcctcttcctaccatgccaaccgtcatcgccccaggttcttctgtctgtcgcagccagaagccctcgccggacgatgctgcgctagctctctacgatgaccctgatccctcttgcgaatcattcgtgggcttctgtgcatctttctcgccgaaccctgactgccgcttgagctccagcagctcccgcttccgtccgaatcggccgtcagccggatactcaccctagacgcaggaggatacctgcctgctcattcatttcacgccaccgcaccaagcttcccgggcgccatgatgcagtggacgtcattcgttcagaaagcccagtccttcatcgacccggcgaatttcactcttcctaccctgacctcctccgaccgcaacccgtccaaagcctccctgtttcgccagcagttccgcctccccgattcccaaaacccgctgcaagagatcaccgcagagctcattcttcctattcctcatacctcgtcaccgtctcacggagaacccaatcgcccttttgttgagcgcgctgggaaccgctatgccggcagactccatctgagcgaacggttcatctgtttctcgacccagccgacgagcttcacgccttctgctagccttggcgcatcgacccattgggctggtcaaaccaacggcacaggaccttctggaaacggatttactatccctctctgctgcatccggagggtggaacggctcaacagtcttagccatgtcttctcccttgcattgacaacatggaatggtgcgctggggaagcaaagccccgacttcgttccgcaaagattcacgatccagctggctggaagcaggcaggcctgcgaacgcttttgcgacggtttgaagaaggggctgcgcgaatgcatgaaggagattgagaacttgcgcatagtcgtaaacgattgttactcggaatacttactgtctggtgctaaatccaaggcccaaaatggagagactgctgaacagcgtcagccacctgatgccgggctgggaatgatattccgttatcccggtgatgctcgcaagcttcgggatcgaagtaagatgagactatggggagaatattttagaggtatgcagcccaaccccagttctatatattgggacgcttattaagtcttcttgtagagaatggccgtaatgccactatcattcgtcagccgaccttccataagttgatccgagtcggtcttcccaatcgtcttcgcggcgagatctgggaggtgacgtcgggttcgctctaccttcgtctgagatcccctaaattgtatacagagacactctcaaagttctctggccaggagtctttggcgattgacgagatcgagaaagacctaaaccgcagcttgcctgagtatgctggtttccagagcgaggaaggtatcggtcgccttcggagggtcctcactgcctacagttggaccaatgcggagatcggatactgtcaggccatgaacatagtcgttgcggctctcttgatgttggtttcccagtaccgatttcggaaatgaagctgacccttgcagttacatgtcggaggcacaggctttcttcttgttgtctgtgctttgcgatcgtctccttccagggtactactccacgacaatgtatggcacattgctcgatcaaaaagtgtttgagtctctggtcgagaagaccatgcccgtgctttgggaccacctcacgaaatctgatgtgcagctctccgttgtttccctcccatggttcctctccctttacatcaactccatgccattagttttcgccttccgtgtactggatgtgtttttcctcgagggtcctaaggttctcttccaggttggcttggccatccttcgaatcaatggtgaggaacttttggatatccaggatgatggttcctttatctccgtcctcaaggcatacttctcgcgtctcgatgaatcggcccatccgaggtctgagaatcccaagctgagggccatcacacggttccaggagcttatggttgtcgccttcaaagaattctcccagatcacgcaccagacgattacggaacagcgtgaaaagcacaaggatgccgtcctggagaacattgaaagtttcgccaaacggacatccatccgcaatctcggtccagacagtaagaagctgagcatggatgatctgggcgtcatctacgaccgttactacgaggttctctatgaccatcagcagaggcagaaactcttggatgaggaaaagaggcgccaggaaaagaaacgggttgaaagaacatcgatccttgggcctccagtggatagagaggtaggccgtgttggtcttggtcctagtcccactcacatggattacaacgctttccgggaatttctcgcagccacagcgaaatgggcagtggcagactcgcccccttcgcgaaaggagtcagccgatcagggcttcaacagtctgaggggctggggcaaatcctcttcattgtggaataataaacccgaaccagcagatcatgagttcacacgacgacttttccgcaaatgggcaacggaccctgacgaaggtttgagcttgcaaaatgtagtcaatggccttgcaagacttaaagggccccgcgacatcatgaacaacatccaatactttttcgacctctacgatgatgaagggactggtcgggtggatcgggaaggcattcttcgcatgtcagaggcactccttttcctatctcggcgaggctttgacggagctatttctcccacacagtctgtggaagacatcaagacgaatgaacgtgacccggataggctcagtacagacgaacgtttcttgggcagtgtcagttcttttatccgtcgttgtttcgaatatgccgatcccagccatccggacagccgagcagttgaaaagcagaaggatcaggcggatgcggaggaaacagccgataagcttgggtcattcagcatcggtgatgatgatgaggaagatctcattgatgtgaatgaagataccaaatcggctgcgtcagctgagaccgaaacactggcgaagcaatcgaatgaagacaagtccaacacgcagcacaatcgcgccgtctcagaatccgcaaacccggcgctcgatccgaacaatcctctgcacattactctacccaccttccgcatggtgatccttgctgatgaactgttggagcaattcttcgatacattcttcccacaatcattccgcctttccgatcatggattgcaagccttggcctcctcgtctctctcatccaacctcaccaccttctccaatatcggcgtacccaagccccagtctagcgcagcagctggcgcttcagtagcgggagcctcaggcggtatcgtgccaccaggcaagggtctccgcggagtcctggacaacatcgtatcagatggtatccgcatggccgcagaggttaagaagagaatggacgaagcacaacgcgaactggagcgcaccgccctcaaccgcgacgacgaagaagatgatgaagaggaggagtacgacgctcgcggcggcgttgccaccgcatccgcaatggtcggcggcatttccagctggggcgcaggtgcctacggcgcagatcccgagcgacggagcgtcagagatgcagatcgcgatctcctcgagggcgccgaagtcgtcagcatgcgtggcaaggacgatgcatccctactcgacgataaggacggacatgagcagacaacacaagggaccccgagcccacatgagccaagtcaagccgaacacaacgtcatcagcaaggtcgagttcgagtcttaaatccaccccttccccgacactacctccatcaccttccttttcccccgcccaccctatctcctttcgaatccttctctccctctctcctacattgtctgcctcatgatttcatatctattttactggttactgccggtcatcacccatacaattgcttgtctatcctcatttagacgtctgctggttgtttctggaagatccattgtatgtatgcatgcatgtaccatgttgttatcacatccccgcaatacaactaaagatctaccttgctttgcgctttataaactgtgtagtataatccgtagaagaatcacactataattaagcgagcacatacagttatttaaatactaatcctctgtcgatctagtagctagtacgaactgtaaagtacagctatcgcaagagtgacaaatttcccctgctcgctgtatgaatatttctctttttgttttgtttaattttggaaaatttcccggcaggtttcaggtgccagtcaaccagctgttggtatctaccactagctagttcggtctagtcaaatgattgatggagggaagaagctgtgttacacatatatattaggtgagcaaacagttaccaaaattgagctttatgcattacaatgcgaggctatcttatgtatgtctgactgactatgccaactatgtatgtacaagatcaacaaacccgtactcaatggcccaaaaagaatctgccctggagtacggcaagaaaagataaagatgaagggaaaggaatatattcaccatgaaataagaagggtaaaaatgggggtatagagtcaaaaagaaaaaatgataataatggggtaagagagaagtcgaaagagaaagggggaagtggggaaaatcgaatgaaaatgagagctggcacacgtcaaaatttccgcacaagtggctcactagtatggaaattaatccttttgcccttcgttctcgatcaactccagaatcaattgacttcgctcgtattcaggatgttgcatgcatatcttgaccgtgcggccattatttgccagggaagcaccgttggacaatccgctggagaggttgacagcacctccggtgcttgtagggatgctgttcgcaccagagcccggcatgtggctgccatcgtcaaggcagacgaccccgtggcccgggatcacctggcgaaggcggccgttcatggcattacgcacctcaacaaagtcatcattgaacaagatgaggaaccttccgtagaggcacgcagagtgggcgtgtcccacaaattccataaccacgctgcgtgatacatcgccatgtttgttcacatacacggcacattcagtgtatacgaccaggaattcgctgtcactgaggcggaacatgcctagtgggcgtagagcaccaatccgctgagctatactgctaaggtgggcttgcgcttcaggtggggcttcagatcggaaatcggggaccgaccacgtgtgtttcttgtcgatggtgagaatctcgatgccgcgatgagtggagattgccaaggaagagtggaagagattcatgccatagctctcggcagggatgtaaaactcatcgtactcccggaagaattccgtctgcgaacgacgagagaaaaggcggcttctgctgctggacgacttctgcgcgactggctcaagtatctatgaactctcatgagtatgcggaacaacgtgggggacatggcagcgcaaaccttgaaagtagacgacagtccatcacgcttcttgtacataaccaaagtccggtctttcatgtgccctgctgcaaagaaacctacttctcgactacccgatagtttctgcggcgctcgacgcgacgagtctgtcgttgcctgtgctgcaacgccgctcggagggcacacaacatccaggtggtaagcaatcagcgacttgtccgcaatgagcagaaacacgttgaattcttcaaagacagcaatttgtgtcacgcgtacaatgggtataaccttaaacggcacaattagtatgtggacggtgtgtagacaatatatgtggtagcaaagagctacttacccgagtccagccacgagggtcattgtagtccgaaacatacacaccatagtcagtgccaatggcgcacctcatccgaccaggaggctgctggaagaccgtggcacagtggaccccagtccggcaaaccggcgccggccgtggtgagccatgataccgctcttctacgtccttgatcgcacgatcaagtggcgtcccgtcgataataacaccagtaggaatgtacgagttgtcggaggtggcaaatgcagtgtcagcgagaacacgaagcctgaacggctccgcattctgcgcgaacaaggcggcagcatgtttggtcttcgcctcggtaatcttgtcacaccagtcttgcctgttttgggccgaaaaggcatagagtgtataggttcctgctttcccgaggtgcttgaccttaaaaggatacaggatcttgtcgtctttggaactctccagaactgtggcaggtaccagagctctgcctccgttcaaattgcccgagatgccagaattgccgctggcggtatgggttaaaggcccgccggcagcaccacggccagcaacggcggctggtgattgcgccacgactccgcggacggcagactttacgaccgggtcatcattggtgctctcaagaaccagaagatccatggggattggcaatttggatacatcgtagctctcgtatttcacggttctcgacgggtccctagctgtgaaggcctttgcaagtaccaagtaatggtcgaaaagtatggcgtgagtgtccaccaagaatcttgttcgtgtccctggccgctgcaggtctccccggaagacgatttcgcggcccagatgctccagattgagttcaacgtccttcttcatctccgggcggagctgaagcttggtagaaagctccatgagatcaaccttcctactcatctcacccaccttatgatcacattcaagtgccaccattttaatctcatcaatcgcttgtgccaaatttgctttctcctcggaatctttgaccatgttcttgtgcaccgtcgagagcagcagggtgtaccgctggatacgagtgatgggagccttgaggtacgtgtcccagctgagacgattcgaaagcttgtggtcacggacttggttaaggaactgccggaaatgaacgttcctctctgcttccttgcgcaccacgtaattggcattcgggaacgtcgccgcgtagtcgatataggccatctttgcctttcgaatccattcccggaaaatatcactaaaaccagcgatgaatggaccctgctctttctgacgatacttgagttgagccaagagatggtcttcgttgactttcttgacggcatctaccttcccaaacacatcgttcaagaaccggtttaggcgcttcggtgcaatcaccgacggttgcatatttgccagctgatcccggtagagctcgcgcagaacgtccagctgggatatgtaggaatcttcggttgtcacaatctcgtgcaaattgttctgtcgatcaatctctttctttgagtgcgtctcccaaacttccttggggaccttgtaaaaagtcacccagtcttctgctttcttctctggctccatcatctgagctttgagattgacctttttcagcgtccgcatgcagtggtgcgaatagcaacgtccgaacacttccgcttcctgttcatgaaggcgggaggagtagcatcctgtgcccgttatctggaataggacgcctgacaaagttccagtgccgaacttgacccattcctcatccttcaccaaggctccctccgccagcatgttcttgactacccgtgcggctagagtttccgcatcagccatgttcatcgtcgggactttgtgggtgaacaaagcaacaattgcctcaacgatcgcatgttcctttaaatccgtctcatcttcgctaagctctcggatccaagctagaatggagctcaacgcccatggctccgtacagcgtcggaattgtactgaagacaattttgttgggttgaacttcttacggcgtcccgcagggatggtgggcagatcaagcgtcatggcagctgcagcatccggggaaacatcaagcttgagcgcgccatactgttgctgccgtaatagctcctgttgctgtttatacttcgcccggtctgcatcggttttcgatctgataggggggtcagtacgaggcccaattggatgactcgacagagaagtcgaccgtggaacttgggtagggctggacacggtcgaagaagcgtacgagtctggagcaacagggaaatgggaaggtgtatactgggtagagccccgcccgtcaccctgctcgtggtgccggtacgtccctgccggcatcaaatgcgacattaagctcgggttactcgccggctcgacgggagccggtggaagtggccgcatgccagggtggaagaagaggtccccaggctcctctcccctgcctgagctctcacttcccgagtgttgcagaccattatgttcggacaagggcccgtcggtctcatcgccgtaatcgaaactcatccggcgtccatacgctccaggctctgacaagcccccggtgccaccagcgtccactcgtgcatgatgttgcatatcagtgtacggatacccagaagcatcgagcgctgtaggtgggtagtcataatcatccgaatactcctcatggccatctgcaaaagggttagagcctctcatggagccggaagagggcgcaagcctaggatgaccagcgtcatcattatggccatttgcgtagtgatccgtctcgtcatattgtgaggcacgacggtagctttcgctataggacccaagctcatcctgctgccagtcttgctgaggagacggtacgcgattctcggatcgcgctccatatgcacttatgatggaagcagtggtctcccgccgcgcacggtcttgcaggcgttcggcttgtgctttgtcttcctcatctgccatttgcagcatagctagacctgcagcagcctctgcatcactatcatcgctatacgcatcgtaattcacatattggcctgtgccagtggcgatactgccattggtgtgagtatgtctctcgtcaggggacagccgcggacctggtgaaacgctatttgacggttccaggaccaacgcactgttagaattcccatgtgatggatccaagctatagccaggctccccagttgtccgtcgatccgcaactgcagcctcgacctcttccatcagctcatcatagcccggcctggtattgggtcgactatcccggcttccatatccgttggcagccatataggggtctgcatctgcatccgcatcaatgggagggccaggcagcgggcgcgactgcgggtgtcgagtcaaagtgtctgtcctacgcggtgacatttgcgtttgagtgggatagatcggcggtgttggaagggatcgtcctgaaccggggcgtgtcaaactagaccgcttgccgaaggcttcttcggtgggtgtcgagtggactgggggtgcaggaggttgttcatcgaacgaagtaatcacatctccagggtgaggcagcgactgcggcatgtgggttggaacttgtgcacttccagcgtagggatggcttgcaacgttcgcagaaacagcagtagaagagctgttggcagatatataggtagcattagttgtagaaggtgatgctgtgccgtaggataaagagccagatgagagtgtggttgaggatgatgcctgctgagttgtgaacccgtactgcatacctggcgaagcatttccatactgcggagacggacggcttccatacggatggtccggtccccgaggcggtggaggcggcggcaactgcgggtgtggaggaccccaagtttggggtgtagggggggcatttgcaaaggcgcttgttggctgtctctgcaccggggatgcgacgaagctagcaggctggtaggcggctggattatagggctggtggccggaggctgtcgtgctgctatacgaggtgctaggcccactatacgccagcggactgaagcctacctgctgctgcgatggtgtagggggcaaggcatattgttgggggttgtatgcaacctgggtaggtgatgtggcggccgggaccgacgaggtatactggtattggtaacttgattgtgaggaagcccgggtgcgcgacaactgaggcgaagtgggcgcagggacgtgcgcatatcgagggtctgcgtaatcatctcgtccagtattaaggacattgtagctcgattggccctcggccggtgcattccagcccggataacgagcattcacctcggtggacctggtgttctgggaattaggggagcccaagagacccgcgtcatcccccacattataactgggcatccttcgcaattgtgggcttgtcggctgggtgggatacaggtcataacggttgtgctgagtgggattcggcggggaaccgggcggctgattgtaggctggataaccattttggtagtgcgccatggttgttcaaggaggcccagcggaaaatgaacggcaggttggacaaaactgactgcacgcgacagcgagagttaggaagacgaggctccggaacggcctgggaaggattctcccgggttgagtgaagctagatcggctcacttcagacactgacagaaaccaccggaagccccgatcacgctcagggccagccttaccaccgcgagataagatgtaggaactagtcgtagcaccagttaccaccaacagtggattgttggtaacgatgggaggtcgagcctcatccggacgtcggccgaccacaattaagaaggaggtccggggaaaagagatccacctctaggcataccccagcagacaagggggagggggatgtcccacggtcggaaagaatatcgttcgtggtgaaatgaaacagtagaccagagggcacgaggaggggaggattaggtggaggggatagggggtggggaagggcgtgaaagattgaacggagggaaaaagagagagggattgatgatctggtcttggagtaacagtccgtcagtccgatggtggttgtttttgtgccggtgggcactcctcctctcctaactcttactactagtagttaatcgctgtgccggttaggtaggcggtcagtttgtcatcttctgtgcctgatgctgggtgtctgccatgcctgtatgcctgattgtcggcgagaatgcgagtggtcaagtcagtctacatgaaggagatctatctcctactcagcaatccgtttggaaaatctggaaaaatttgatgggaggagactcagtgatttccacgcaatcttgatcgatccagacatcaaaaccgcagcgtttgtttacttattgtcagtctttacaaagtcggcaagccatggctataagattacaaatagaaaaaggaaaaaaaagaaaaggaaaggaaaaagagatagataataatgcaagctgctgcaactgtagtttatttcaacttagcgtatattattattactgatactgcagtggctaactatggcggcggctcagtcttacccgaaccgagcacaagactcatcctgcctcatggtaactaaagggccttgattgaagtcaagaatcgaaataccctgatcaactgaatgtttttgtttcacctcgtagtccactcaagataaatctgctgtatggcattgaagcatattgtaaatcttgccataatctacggttttcctgtgacacaaactttaagcacatataaatatagaaagtgtcatatgtcatatttaggggcctaagggagagcgtgacgaggccaacccaaacatagaaatagtcaatagttcagttacaagatttatatacattttcagtggtttttgttagttctttgtatctacagcattagtagttatataaaaagtaggagtagtactacgaacacaatcatcttttcaatgccattaactgaaacctcaaccggaaacctactctatctagccatgatcgcttctgcaacagtaccacctacacattgctatatatagttagcctgtgtgacttccgggatactatgatcagggacagctgaaattgcgtgagggtatacccatgctgtacgactagtattgttgtgacctgtagctaatatcaaagcagcatgactttccttatccttttttaaggcactatagaagagaaacttcatcgggctgcgatgttatccctacgagccccctcctcctctaagagtaacggcggtggaaattgccttgtgtgttaaacatcatgtggcttgatatttgtttgtcagtaatggcatcggaagaccatgcttccgaatgctattctgatctgtcatatgacttggagatcggtactggttgcaaatacctgcaaaggcaaatctccagctcaaataagaggaggggtggtatttattacagacacaagattgatgaataggcacgcactgcttggaatggaattgcaaccttacagagcaagttcagacatcccaaagcgatccataatccattgtcggtttacaggggaatggtaatatggtatacggtatagtggtagtggctcactatcttccatggtaactatctgacagctcggaagggtttagatccggggtaacggtggggttttgcggatgcagagctaaaaagcccccgagatacgcattcaatacgcacccaatcagggcctgcctggagaaccttccgcggaagtgacgctgagataatgagcgatgaccgaattgggcctatgatgaatacgacttggtgatggaacctgaaaaataccttcgccgttatatttcactttcggcgagtcattcacaagctacctcatatatgaccctgtttctggtcatgagctcatcataggataggagatggcaatcaagtcgtagtcgaacagttaaacagcatagagttgatcttgtgtccgggaaggaactgagaggccgtgtgtacctgattgctcaacatacttaactttccgcagatacgggcctggatcaccagacaaggatcaggtagctctttgagcccgatgcccatgtgaagtcggatgctggctttccgtcttccgggtttcgagaccatcgacaatgtaccaggtaacgaaccttattgaatcactgaaactttagggcccctttcatctgttctctgactaccttaacatgccctctcagtccttccttccttgctttcttcccttttctcctgttgtagtttgggtctcctgcatctctgtgttttgtctgacagtggacttgccgttgcttgtttacaattctagtgacctactatgcattgcgtaacctcagattggtgacaattgttatggccagtcagccagcccctcctgcgccctttgggacccgggctatcaccgctgcgctgggctcggagctggaaagttcaatgcgcgcgaccatcacctctgggggaaagacggagagctcagattccgcttgtttagaatcggaagacagtatcagacgggaagatcaggaggcaataaccaccctggcgcgcagcctttcacagttatccagtaaaagcagcatcggcgaggggacgaataccttccttgatcctactagcgacccggagctggaccccaattcggatcagttcaactcgcggaaatggacgaagaacttacttagaatcacctcgcgtgatccagatcgctatcctcgccgcacggccggcgtctccattcgcaacttgaacgtcttcggctacggaactgcagctgattaccagacaaatgtcgcaaacatgtggctgaaaggattcggttggcttcgagaaaagctcggttgtgggaagaaagtcagaattgatattcttcgcaacttcgagggattcgttcacagcggcgagctgctggtagtacttggccgccctggaaggtaaattcacgcagtgctgctttccagcctctcaattacgtgatgtggaaacccatgttcatattgctaacgggtaatacttatagtggttgctcgacctttctcaagaccattgcaggcgagactcacggcttatggctcgaccatggaacagatattcaatatcagggtatatcttgggatgagatgcatagccgtttccgaggtgaagtcatataccaagcggaaaccgaaattcacttccctcaactctcagtaggcgatacgttgcactttgcagcacatgctcgtacaccatccaacagattcccgggtgtgactagagagcagtacgcaacccatatgcgcgatgttgtcatggcaatgttgggcctgagccataccatgaacacgcgtgtgggtaatgaatatatccgaggtgtgtccggaggggaaaggaagcgtgtcagtatagctgagaccatattgtgcgggtgtcctttgcaatgttgggacaacagtacgcgcggcctggatagctcaacggctttggagttcgtccgtaagttacggctttccacggactatacagggtctaccgcaatcgtggcaatctaccaagctagtcaagctatctatgatatatttgacaaggtcattgttctctacgaaggccggcaaatatacttcgggcgctccggggatgccagacagttcttcatcgaaatgggatttgattgcccagaccgacaaaccactgccgatttcttaacttccttgaccagtccaacggaaagaaaggtccgtgaaggttatgagcgcttggtgcctcgtacccctgatgagtttgctgctcgatggagagacagcgctgagagaaagcagctgctcgctgacattgaggcttttcagcacgagttcccactaggaggagaaaaattgacagaattcaaccgctctcgtgcggccgaaaaggctaaaaggacacgggcaagatcaccctacacgctatcgtaccctatgcaagttcgattgtgccttcgcagagggtttcagcgtctcaagggtgatatgagtatgaccttggccggtgttatcggcaatagtgtcatggccttggttatctctagcgtgttctacaaccttgggcctacgacagatagttttttccaacgaggagccctgattttctttggaatattgttgaacggattcgcaagtgcgcttgagatccttactctatggcagcaacgaccgatagtagagaagcatgataagtacgctctctatcatccatcggcagaggcaatcagttccatgattgttgatcttccttcgaaagcaatcgtctcagtggtattcaatctattcctttatttcatgtccaatttacgccgtacccctggacacttctttgtgttctacttattctccgtgacaactactttgaccatgtccaacatcttccgttggacaggagcgatttcgcgatctatggcccaggcgatggtaccttcttcgatcttcatgctgattctcgtgatatacacgggttttacgatcccggtccgcaatatgcatccctggttccgatggttgaactacttggacccaatagctgtaagtgtgcctgcataaccagtcaacaataccacacccacaccttgcttgcaattcaacaccaactctgctcaagccccatgaccattgctaacatttgggtagtatgctttcgaatctctcatgatcaacgaatttagtgagcgtcgtttcccgtgtgcagtttatgtaccttcggggccaggctacgaagatgctcctattagctccaagatctgcagccagaatggtgcagtggccggtcaagactacattgatggcgacagatacctgaatgtctcttttcaatactaccgatctcacctttggcgcaactatggcattctattgggttttatgttcttctccctcgcactttacatcatcagcagtgaactggtccgcgcgaagccttcgaaaggcgagattctggtctttcctcgcgggaagattcctgcatttgcaagacggatccctggtgacggggatgtggaaagctgtccagcctcggagaagtacgccgtcgatggtgaagagcctgaccatacagccgccattgtcaaacaaacatccatatttcactggcaagatgtctgctacgatatcaaggtcaaggggcagccacgcaggatccttgatcatgtggatggatgggttaaaccaggcactttgactgccttgatgggtgtaactggagccgggaagacatctctcctcgatgtattagccaaccgggtgaccatgggcgtggttactggcgatatgctaattgacgggaggatgcgggacgactcatttcagaggaagactggttatgtccaacagcaagatttgcacttggaaacaaccacggtgcgggaagccctcatattcagcgcacttcttcgtcagccagctactacaccgcgaaaggaaaagctcgcgtacgtggaagaggtgatcaaaatgctgaacatggaagcttacgcagaagccattgtcggcgttttgggtgagggcttaaacgttgagcagaggaaaagattgaccatcggagtagaaatcgcagctaagcccgaccttcttctatttttcgacgagcccacttcaggactcgacagtcaaactgcatggtctatctgctcccttatgcgaaagctagcagatcatggacaagcaatcctatgtaccattcatcaaccatcagcaatcctaatgcagcagttcgatcggctgctattcctagcaaaaggcggcaagacggtgtactttggagagcttggacagaacatggagaccttgataaaatacttcgaggggaaaggctcttcgaaatgtcccccgaacgctaaccctgccgagtggatgttggaagtaattggagctgccccaggatcccatgctgacagagattggacagaggtgtggaatcaaagtcctgagcgcactcaggtacgtctagaccttgccgagatgaagcaagaactactgcagcggccaccacctcctctcatggtggggtatggagcgtttgccatgcctctttgggcgcaatttgccctttgtctgcagcggatgttccaacaatattggcgtagtccttcatacatctactcaaaggctgtcatgtgtgttataccagtaagtatctcgtggtcctctcggtatgcagagctaaccggccaccatagccgatatttattggcttcacgttttggcgagagccgaacagtcttcaagggttacagaaccagatgttcgccattttcatgctgttgatcatctttcccaacttggtgcaacagatgatgccatacttcgcaagacagcgagctctgtatgaagttcgagaaaggccctccaaaacgtattcttgggtagctttcatattagccagtgtactggtcgagttgccctggaacatactcatggctgttccggcgtacttctgctggtactatccaatcggcctctatcgcaacgccattccaacacatacggtcaccgaaagaggtggcaccatgtttcttctcgttcttatctttatggtgtttacctcaacattcagttctatggtcatcgcaggcattgaacagccagatacaggtagcaacatcgcccaacttctgttctcgttctgcctgatttttaacgggtaagtcagaccgcatcgcttgtctgtcaggaaggcttatcgttgtgaatctagcgtcctggccaccccgtctgcccttcctcgcttttggattttcatgtaccgggtttcacccttcacctatctggtatcctccgtcttaagtgtgggcatcgcaggaaatgacgttgagtgctccgatattgagctgctgcatatcccacctccaacgggacaaaactgctccggttacctagacgaatatgttcgcaactaccaagcaaccctactcaatcccgaagataccaccgaatgccttgtgtgctcgatctcgaagaccgatcagtatctgagcgcgctgagcatgagctactcggaccggtggcgtaatgtgggtattctcttcgcgttcattgtgttcaacgctatcgcagccgttttcttgtactggctggtgcgagtgccgaagaagaaatcggtcaaggagaaggaagagtaggctggaaggacaggaaacatagatggagaagcctagattggcatggcggaggctagatcatcttcttacaaagtagagtagatatgggggtatttggcttgcatagttactagtcttagctccttcgtatgtcggcacgtcatcgctagtctacaggccatagtcttttcatctaatatgaatgccacactatgttctttcaatctccccgattcagataacctagggtaacatttcaccagagtctagatgcagccggcacaataccccaacaaggcgcattgtcaccattgcacaaaacgctacgttgtggctttgccttgcccatgatgtcatttaatcgtacagaacagagtacaatgatttcatcgaagctagacatagatattcccgcataatacatacatacatgtgagggcacccaggcgtcactggggctgtggtgcaacacgcatgcggtgtgccgcgcctgcagcgcagagcgcagcccgggcgggcgtgagatccagacccagaccaggccagaccaaatcaaaagatggaaaggatgtccgcccgggcgctggatgaaatgaaatgaaatgatggatcgatggagggatattcccggttggggaagaggggaaagaaaaagcctcctcggggaatgttgaatgcacaacattaccgtcgcaccaggcaaagattctgggcgataaattaccatacgtgattgttaccgattgggcttccaggagcagggatgttcatccgcgtcgctcggagtcggactcagaggtaactaactagtaactagttatggtggttagttagctagttagttggccaacccaattgagtaagagtcacagtcagagtaactactctgtactccatagctagactggagttaaccgcgcgatcatgtggctttctgaattaatttcccggaagcttccgaccacgcttgctagctgcgagggagctgcagtcatggtggattcgcactaatttttccttccgtgctggtagtcatcgaaagattcaatgttatcattgttgccgtccattagcgggggttgtaggggtgtcctgatcacttggcaatactgtcggagacaagggttcgaaggaaagaagcctcgcaagacttcgtggcagatgagacgacggcgaatcattttacgaagtagtaaggcagattcgagggcacagccaacgcctcagccacacgaggattccgctcggtggtttgtgtgtctccgatgttggttgtccagcatgccagtgtagcgcgactttgaccaggcctgatacgctggcctgagagttttggacggggatgacagcaaacgaccttagaactaatcgccgggataaagtccgatgcgacatggccttgttaacttgtttagtcaactgtgccttggccagcaattggtgctcatcacaagatcggcctatgactcgatcaacgctaccccgtagtaccaaagtagtgtatccataatcatcaatgtttaatttcgtccttaacgaagtgccctatgagaggttaagtactcccatgatcttcgagcggtgacacagtggatttttttcggccccccaaaataggcactaagtggactcaagcagctgcgtccacaagatgcacattgcttcgtgaactttcatattaacgaccggagtccagcagatgatggacaggaaaggggtagatagtaggaagtgggtcaatgctcttccagtaatgcgttatcccatccaagcgacgataacgaatcccagctcggaggatgaccaaggtgctaacgagagacaccaccagacgatactaacggtatgagctgtcagaccctaagcggatatcctgggcgggtggcaccccaggggctatccgcaggtgtctcctccgatcaagagttagtgacttcttgtcattcttcctgtgttctctgtgcaccattccagaagcgtgtcggggaacagcgtggcgcgggcttagtgccgtgcgtgcatgggcaacagggccaaaccgcaccctggaaaaggtcaacaactgggcaagaggcaaccaactatggacagatcaggattccgctaatcgtcgaccattacccgtttgagagttcccgcagcataacatcgaatgggagcgagggttgatgcagcgaatgactcgaaatgttggttcacaatcagacgagctcgacgataacgctcgctaaattgacccgcggcagccccgtatagtttggcccccgaaaccctgtggtgcttagtggttcctccgttgcccgactaatgcagcattagctcaacactgcctatcattgaggctgaactgccttctctgggtgtgttgggcaaagagacgagaggccagcaaggccaatcacacgttggaatgtggatgcgcgaaatttgggctgtaagccacgagggtgtggaaatagtctgacgccagagactggcaaagacacacttccaagcgcgaatggattgttgtcgctcaccgtctttgcggctctctcgggggaggcggacggtcggagaagcctggagacaggcccaaccttttgcccagatcgatcatttcctctggtggatgccgccgttctgtcaatccctaaacacgagggccaccatccttgcagcccacaggcgccgtcttacgacgatgccagccaaaccttccacggcggaatcgatacccacctagaagtaaggaaaattaaattgcattaacgatcgtaaaataaaattgggagaaaatggaaagaaagaaaaaagaaaataataaaaaaaggggggacttctcccgaaatcgcagattatgactggctgattcgagtaggttgacatccagacgcccggcctagaagattatcggccgacgctgcaggggcgcactactccggcttcccaaggtgcactccaacctgatgctctcgacaaataatggctcagtctgttcagtcgatgcggctcaacaatggccttgactccacgctcctctcggttcgcagtgacccatcgtgtgtaccgccctcgtaggccagtacataaccatggcacccccagctgaagaggtactgcctctggtttccgttgctataaagcagcgacctttcagctggcatagctttggatccctggaaagcaagcacaacgtcgcagcttatacatgatggcccactttcaacccttcccagacctcccgcatacatcctccgaggacaatctgccccaggattatgaactatttccctgtcagtacgagccttatgcggaccccacggctattcaacgcccttcaagcttccaacttcatctctctcctcctatcgacctacctatgaagaacccttacatcgccccgtccatgtcgtggtcaaacgagccagtcttacctcaaaacaccgacgcattgactgctacttcttctgagttcggctcaccttggagcaatgaactcgtctccagtccagaagcgaaagacagtctcgccaccggtagctcgagttggctcagcatgggatgctatatgtctcctccatacacctgcgacgaagtcgcacttccgccattggggttcgggtcttgttcttccccatccgctctaacagacgttgacagtctggtggcgccttcccaagtatatcccgaccccgaccctattgtgaaacttgagtcagattcggagcatgttatgggcggaacgttttgctacaacagccctccccagcacgatgaattcgataccggctgtgacattcaaagttgccaatacgcagagacagcaagtcagcaagaagcctgtggctcttccggtgatcagctcaagacaccgaggctgtctagcacgaacacaggccgcatcagcaagaagcggcctcgcaaaacatccaccaaagcaaaatctacctctgcagctcgggcccttaccaagaccgggagtaagaaggaaagtgcgaagtccagccgggtattcatctgcagcttttcccactatggatgccagagtaccttcgtttcgaagaacgagtggaagcgccatgtgacctcgcagcacatccaacctgggttctaccgttgtgacgtcggacgctgcagtctggataatctcaagggcaaggatcaggacacgaacaacagttgtgcctcattcaacgagacacatcttgtgaatgacttcaaccgaaaggatctcttcacccaacaccagcgtcgcatgcatgctccctgggtcggacgcaacagcaagaagcccgaaactgagaaagagcgcgatgatttcgagcagagccttgaagcgattcgggctcgttgctggcatgaacagcgcaagccacctacccagagcgcctgtggtttctgtggacagcggttcattggagtccggagttggaacgatcgaatggagcatgttggtcgtcactacgagaaaggtgacgcggaccatgaagccgaggatactttcttgcgccaatgggcagtggaagaggacatcatccggcaggtggaaggggagtggaagttggtcggtctttgtgagaagtgaagtgaaggctacaattccttcccaaacgatccaactgctgcccctccccgccttccttttcctcttctctaaccttttatttttctgggtttgacctgcttctttattttctctttatttcctatgttgattcatctacttccttttaatactcccggtctggctatggattctgcacgtctacgtgtgcgggactgactgagatgatgattaatgactgatatcctgtattcactatgttttatgtcatgtttattggacccctttgaggtttccctggttttgcacaataccccatacacactgagagaaagaagcaagggattgctgagctacatggttctggttttcggcattattcgagcacgtggagttcatgacgaatagagaatgcgatgatacaccattcttaccactatactgcatattctaccattccgtaagataatacccgatagatactactcttaagatagacaggtaagtaagtaattcatcctcagccgcagcgactgtgagatcgaccaaccagttcagctcgcctcacatttccagagaccccctcaccaatcattcccagacactaaagtagcatcgtccggtgcatgtcagcatagccccccattccagatactgcaaatccaccagaatatggagcccgaaaagaagtgaaacgttccacgtggcacgggtacccccggcgctccaaaacgagagtttcccatccgatcagtagtatactgggactgacctacgtagctggcccctttcttccttcttccttccttcctttcctccttctagtccagtccatttctctccactaccagatcgtcgggtacacaaaatcatgccacgggcctactacctgaaacgatagttcgtcttacatgctgacacccccgtgggctttggtcgttgatcggggaggaccatggtgcattcctaatatgctcggtaggcatgtataccggttctagatatgcgcccgatagggtaatgcaatgcgttagttctggaggtactcggacacattaagaaaatcaccgagattgatcggcagacacatgtccagttacgaacacatacgtatctgagtgtacctccctctgtgcgtctactacgtatgtatcggccgcccagaacctacccgcctgccggccgagctagactagtgtatcagaattcagctgggactggctggggtgggtgagattttagttcgcatacagatcggcgggtcagctgcatgcaccttcatctggactggatgggagcatccattgactgtgttcagttgtaatatgtaggttggaattaacggggaccattctagcattagactagtgtatgtaatcaggttgtactgcatcttgagtcgcgcgtgggttttgcttgctttcctttcgtttttcttgttttgatgacagctgaacagggttctggaattcgggtgccatgtggttgaattgtatccgggttggctcgcagtacgtaaacagttgtccagactgacgcgcgcgcttcatccttcttctgtaaggggtaccctcttctttcgttgttcggtttctatttctggtcctcgctgggtgtatactccgtggtcttattttgtttagacgcccgggacttctctggaccgggtatcgagtagtgcagtgatagtcgctggccatcaacggggatccttggccttgtcatgtcacagattaataggttcgtgtcgacaacagcgctgatctttctgattgctattctggggcgcagcagtggccaatatttttctggcggccaccgaatatgcagttggaaccaacagggcttagaaatcttcttccagggtagcagatagttgtaccgaaaagagataggatcgaattgttgcctagacaccagtagttacagaagcttcattatcgcggtattgtagttagcacatcaatgccggtcagaccctggttattctgcttttcgacaataggctgagacaagagtgtcactagtaaactgcaagagcgtattcgtgccacgcagaacaatacttccacggagattccatctgtgacagtccaaatccgtgccgttgctgctatatgcatgaggtggatagaaaggtactatttcccttgtgttcgttggctgttgtcaagaaccagccatcaattgctccggcggtaggctatgacgcgtgcggggatttcaaggtcaacgcggggttccagtttcgcaggacttcccgactatctaattacgcattactactcgagcaccacttgaccaacattctgcagtaaatgcatatcatactatccgtgaagattatctcttccgacactaaatataacctgaagaccttccaatctgcctaattcgatttctactccaacatggcttcgcaaaaccccactccatacccattccaattcgacacctctaaccacatcgaaacgcacaatgataccaccacattgacactcaagaatgtccgcggtagtatcccgtctacacagacctctcgtctacgtacaatgtggctagaagctcaccgagaccctgccaagataatagcccacccatgcggctatgacggcctttctgcgcgactgatagaggaagctggcttccctatgattttcatttccggattcgcggtggcagcctcccatggtcttccggataccgggtatattgccatgggagaaatgtccgcccgcatccaggaaattgttcgtgtgacgagtattcctatcatggtggatggagataccgggtacgggagtcctatgaacgtgcgacgcaccgtggagtgttttgctgcggcgggtgcagcgggtgtgatgattgaggatcagacatggccgaagagtatgtattggttctttggggatccgtgttcacaataaactgggccaagtctaacgaaatccgtgtacaggatgcggccatacaaagggtaaatcggttgtctctcgcggcgaagcctatgctagggtacaggctgctgtggatgcgcgtaatcagggacgggatatattcatcttggcaaggacggattcattgatccacgggtgggacgaggcaatgactcgggcgaaagagttcaaacgcataggagcagatggcgtgtttgttgaggcattacctgatagggaagctatgaggaagtgcgccgaggaactggatatccctttgcttgctaatataattgagggtggaaagtcggagaatttgtctgcaaaggagctggcagagctggggtttgcagctgtcgcatacccctggacgctggtagctgcaaggctgaagagcgttcgtgaagccctcgatggactaaagcgcagtctaatgagtggagcgccgcccatgatacttggatattctgatgtttgcgaaggtgttgggttcaataagtattgggtgagtttattttcttcattttgtctgtccgtatgctgatcatgtcacccaggacttggaatcaagatatgagtataatgaggatggactcacaaaccctccggaagcctcttgatcatggcacaacctgcttcacgttgaatatgactgattcagttccccaaagtcagctccgcggacatgaaactatgagcatcgtgaaatcgatgatgcggactcttacccgcgctcccggcgcgaatactacaaagacaggcaaaacaataaactagggaatagcattcagatatgatatcatccgaacagcacatacactgaatgacccatatccatgtcaagccaaatgtttgtagcggttaaatccttaactgctggcggggctgatggcccacctcggcgttaagccactcggcgtcccaattcataaatggcatttaagaccgaatacccggctctaaataccacataaagattgggctttgtctcaacaaattctcggcctgaggcgtccaagccgatcagccagccctatggctatatctattgaccgatggtatccacaaatgtcctgaatccctccgaggcgatgatacaatcggagataaaatcagagaagtagtggcgcagcgatggagagatggtaaagtggactcaatcctactaatagtagtggttctctacattgaacgtagcagcattatggtataaataccgactgccggcacctgttcaccagattgctcaagaccaacagacataattgtatcacttgaacatctactaccccaaacagctacatctatctttatactacgaccagaaatacccctcacagaaccttacaatcatctactactacaacatcccacttcctttaacacagcaatggcctcacaagacaccgtaagtccccaacaacaagtgaaaccagcctcaatccttcgaacaacctaccaaaactaatacccatctacatcagattctccaaaccaacgcccaatcagcccgggaatacatcctctctcaacccagcgatgccctaaccaacaacccctgggccgtctaccaggccctggacctctacagccgcacagcgcgtctcatgaacttcaaacaagccaagctcaacgtcgccaaagaagccctcacatccatggaaaccccaccaaaggtggtcatcgaattcggcacctacatcgggtgctccgccatcgcatgggccgccattctccgcgacctgcacggtcccttcgccgagggtctgcacatctacacattcgaggtcagcgagacggtggccgacgtagcgagggatttgatccgcgtggcgggcgttgaggacatcgtgcatgtgatggtggggcctgcgtcggagtcattggcgaagttggttgaggaagggaagattgtgaagggaggagtcgatatggctttctttgaccattgggagaagttttatctgtgtgatctgaagctgtgtgaggatctgggcctctttagggtcgggtcgagtgttattgctgataatactgatattccgggggcaccggattatttggagtatttgagggctgggggccgtgggggtgaggggtccgtgaagtatgtgacgaagtcggtgcagtcggagcatattgttgagaggagaccggtaagtttgatccatgtcttgtgttgttactttgcttgggttgtggatgttggctgatcttgacggattggattgtgcagaatatagtggaggtgtctactgttgtggcggctccttgaggggtcttagtctgactctggagagaggatgaaatattggatatgatgttaacggactctaagattcattgtatgacagtttttgtatgctgcgttgttttcgaagcttgatatcattccttgaaatagcaggttgatctttgaacttgaattttttggtatttttggtatatactgtggattatggaagtagaagtaaagtcagcctctaccggcacaatactcaaaaaaccataaatatgggcatcgaaatccagaacgtcttttcaacctgtttagctgcgaaaccattactgccatctaaaagtagagattaatctatggatattaaacccaccattggctatcaccccgtactccagggcggtgaagacaaaaccaccccgaacagctgggtgcagtatagacacccaaccaacagcggcgcactccgcaatgtctccggcaaagacgcccatgctatgatgacaccaacaacaattacgatgtgaatgcgcaaacacgcgaacaatctccctttacagtcaccatatctatcaacgacaagcgaattcaagtgatgctggactccccaacaacctgaatcccagctcaaaaaggacaacaatactgtccgactccgacctttaatcaccatcaccaaccccctcctccgcaatgtacgtcgcaaccgaacttcctttagcaaaatgcacacctaacaatccccatatagggccgtattctccctcataataatcaataaagccggtgggctagtctaccagcgcgaattccagccaggactgcgcaaactctcgacaaacgactacctcgtcctggcgggcacgtttcacgggtacgcactcagctccctatctctcccctaatacatcaattcctaagtctcacatactaaccaccttattcattgctcagtgtccacgctatcacccgctctattacccccaagctcccccttgcccccgccgcagcacttgcaacaacacccaccaccgcgaccacaccctcccccagtaatgtcgtttctccctccgccacatcatcaacccctacctcttctacagcctcatactcgtacccgaacccgggtgtaccggcgaccggtctcgagtgcctagaaacggacaagttccgattaacgtgctttcagacgttaacgggcaccaagttcctactgtttacggatccgctgatggcgaatatcgatgtcgttatgaagaagatatatgagctgtatgcggactttgttatgaagaatccgttttatcagttagagatgccggttcggtgtgaggcgtttgatcggaatttgcagggttggttgagggggaggacttgattgatgggttggtttgtttcggggaggttaaacgtgctggtggggttgtgatagatatcttctttgtttttataacttttcttttcgtttcttttgcttctccttttctgcggttgcatgcatggacttgtttatatctgggcgtcatagtttgtatcatgaaacaacaagtttacgatggcgatagatctgcatattagatcgcatctgtttcaaaagcgtgttgctggggaaccagccgctttctacaattacagcaagaaaacgcaagtacatttaaaaacgccgggtatgcatcaaatcatccaggaggttgttctggtctccacattaagcagtgtccatcttgtcaccatcctctttcttgtctttgctcccactggagccctcctcgggaatgttgtccaggttggctttgcgctcttgctcctcccggtcgcgcttttccttctcttgccggttcttctcctcttccaaagatagacggagggcgaatgccagttcggggtcgttctcagccgcatcctcgaacccaaaggcaccatcgccgccttcaggacctgcaccatcggcaccggagctgtccccgcccagaatgggagtaacctgaagctcctcactcagcaagttggggcccgggggaatgatggcgaggttagagccgtcaccacccttgacgttctcgacgaaggcctctagtttcttggtctgatcggattccagatctccaaaggcaattacatcgatggacacgttgttcttcttcatcttcttggccagcttcactaatgtcttctcgtcttcttcgatgggagagcaggagaacacgatgatgcgctgtctctgggacttctcggagcggtgtttgagggcaagctgcgccaatcatcaggttagcaatgcaatcaatcccgtacagtatctatctgaagagatgatggagtcgtttgaacatacaccggccacttgtatgctggagctaaggtgggcagtgccatggatcttcgtgcgatgcagaccggccaggataccaccaaagtcggaagtaaatgtcgaaaggacctcgggaccttttccgcccatgctcataagaccgacagcagactgagggtgcacgcgcatcttagtggtgtgaatgacgctcacggcgtcgatctgagcttgccatcgtgtcgagctggcagctgttagaggcggaaccagacggtcgattctgggcgatttagaacagttaacttacgtataatctccatttctgctgctttcgctattgtcgacactgtagatggcgttagtaggtgcgcacagagcttgggatgaaggtggctaaacggacatgatcatggtagcttcgagcggcatcttggaaggagactggcggggttgatgatagaaacgtataggtataatcaatcagatttggaaaggagaaaaagttcctgagagttatatgttcagagcgtgggagcaaggcaggagatgggggagaatggatgatggaggttggcggaggagggatgatgatggagctgctgctgaggaggacgcagatgtcacaccgtcccgatcggagctaaccacgaattaagtcagcgcttgtttatcctctccgccatccgctttcctccagaactcgctccaacgcgctcccctccgtctttcgacttccatcccttccgtccccaattcgtccacacaacacattctacgcaatacagctcacctatcacttcctctatcgctcttatccaccacccatacggctactcacgattgcgcccaatgacttcactctctgctaaacgcaagtctcccgaagacgcgtcccacaatgacgaagcaaggacacctacgaacagccctcctcggaagaagcttcgtattacccgcagacaaaagcaagccctgattgacaacctgcagctcgaacgtgcgctctcttgatacctcgcttacctggcaatccactaaccaagccatagttaccgagcgcgcccgcaaacttcgcgcacagtatgccctccaggcgaacgatcttcgggcacggattgaaagacgtgtcaatcggattcctgttgcccttcgcaaggcgacaatgggcgagctgctggagaaacacatggcctctcttcgggcccaacaggcgaatccctctccacggaaacttctcagcccggccaaagcgtcaaggagtttcagaaccgtttctgtgagccccaatgtgcgcaaggcctctgctgcgagccctagcgcccgcagagtcaagaagcaaaggtacggcatgagtgccttcaacttatacgtgcatgtatcgttgaacagcgctgactcgagcatccagccacggagaaatctattccgacaaggaaaacgcccctgcagctggcgaacagctcgatgtcctcaagaacccaaagagacgtggacctggtgccgctgctggtacttcgcgtgttgtgtcccaagagatgaggggtgcagactacagaatcctatctcccaagacgtccaattccagaacatatccgcactcgccgttacgcgcctcacccgagaagccaacgaactcttcctaccttgcaagacccatgtcgcctctgaaacccaccagcccactcaaatcaacatcagctagcattcctgcactggcagacaacgctcgcattaggccagtcaaaaatacctctacctcgattaaggacaaccgccccccatcacaggctaagagacccgccagccgagccgccacagccactagcaagactacgcgctcaccactgccaagacccgcgactcgccagctcgaacgcagaggcagtgtgtcatcgtccgcatcctccggaacaaccgttgccaagccaacaaggacaggtgccggtgcccggaaggcaacgacagcatcgacttcaagcgcgaccgcgaagaagacaacagtcgcccggagccaagcaacttcggccaccgcgaagagaaacacaacttcggccaccagcaagagggctcccactcctgccggtggtgaagctccaactgcggctcgtagagtccttcggaaacgcgcataagtgctgtattcccaactcaaattaacccttttgaattagcatgtttcgtttcaatcattggcttatctgcagggacatggagtaaaaaggggtgtattatctctgggcgggattataatatggaaggataaccggtgtacaaatggagttctgtcctgtcctttttccaatcaggtccttttgtgaccatattggctttctgattttgcttctcttgatactgccgcttattgattatttccgattacaagtggctttctttcaaatcttcgacactttacatctctccactggcttgactcgtatcgcaggcacttgcataggcagggcagagcgctttctcgggctatcgtaacagtactactcttcttcatcaccaaaacatgagagatagacttaggagtaattgcgggtaacgtcttcaattagatagatgccattaatgggtactacgcgtatgcgatgatgatcatggttgaaggttagctagcacgaatggaagaccaacaatagtaactactgggcaagcatgctctactcttgtcacttttcgggatagaggttttctttctggttcttgaagcatggacgctgacgaggagcaagcgagcagcacacaactttgcgcacttcaacagagttggcactatggcattcctttcacaattgtatgtaaattacacctcctgttctcgaggaaacagcatcgcatggagacatggatgtgatagaaccagtcacgaacaattcgggatatcagaaaaagaaaagaaaaagaatcaagtcgtatgggtagaatgtaaatagggggttagaagaaaggaagcaagaagagtataagggaaaaaatgaaacgaactgaacatatgactcagcacaggtatctttgcagtcatcagactggctgacaaatgaaatcaagggcaaacagaggatctcgatagtctcacatctcgatcggtagtaggttaagggggggcgcaacgccaggaagacgcaagtgatgtaaggaacaacaaagggcaaaaaaaagcaagatgccaggagaaaatgcccacgctgggtctcaactgttaatgcaggtggaatgccaggaaaataggaatcgaaaacaacatccagatcccagaaattgccaacccgaacgggcagaggctcctgtggccatttgcgcgcggttggaatccaatttatagggggcagtgagtgaagcatgtcgagactcacaaccaaatgaaacgcaccccacgcagtcagtgcgcaagagaaagcaattagaaaagcctcgatccatcaggagaagctgtcagccgatcatctaactaaaccctggaaatcatctcatttcaaaaggcgaacaaactccatccaaccttgttaaatcgaaagaacgctgaacggtccaagaatacgccaagagcgatcactaggatatagaggcgggtaatgcattggtaaatgtcttcgaaactatgcagagaaggaacggacgggttggcgtcgtcaagagcacaactggcaaaaaacttagccagcaacccccatgggcccagctcctggacgagccctgtatggcattggctgagactgtccttcggcttgcatagggttctgctgactgccattactggtgcttctttcgcgatagtcattggaagctgtaggggccagttctgtaccagcttgtggagtaccactggtcgaatgctgatgcccaccagggctttgaacatggcgaactgagctttgcatctgccatgccgtgtcttgggagggatctgtctcgatacgggcagaagtagggatattggcagcgcggttcgaattcgtaattgtaacggtttcgccaccattgctcgccttgggggagaagcttccgcgcgcgatatcgccgtagcgtctaagtatttccttagttgtgacttcggtgttttccttgaagaatgttgtgtcgctaaggaccgactgcagatcctcgggtatctaaccaaaagcatgagtatatgaaaacactggtcaatatcggagagaaacatacctcgcacattgtatcattgtatgtaatcaggcaattaacggcttcgattgccaggaaactctcatccaccgtgctatttttcgcattggggtagagaatattgggtgtcattactgtcgcgaggttgtgtatgtccatcttactaccggactcctcatcaacgtgcgagaaagatgacgtccagttaaggaaggcaaaaagtacttccatagtatcccgatgagccttgggaagaaggcagcatgtaagatgcaatacacgtttttgcttctcagggtcgggtaattctgtggtataatggtaagtaaacaatgttataatgtcaaccagggccgtcagtcacttactttgtgaaacaacaaacagacgatggagcttgaatgtaaggagaggatcgggcatctcgcggagaaacttcttcaacagcgcggcaatctggacaggattctccttcgtcatgtccacctgttcatatttgttgtcgatcatttcagagatgtctttcaggcgcctgatattgccgttctttcggaaaacaccctccacggacatatccatttggcgcatggcggatacagcgtcatcaaccaaggctggaatacgaagttgtcctggacccacaccatgactagattcagtgccctctctttcaacaaggaaatccaggtttaccccgaacacgcctttcttctttccaaccttcttgccttctttgttgaaggcgcggccaaagatattccatatggtaggctttcgtgattcgatcaaggagagtaattcctctagcgtgaaatattcactcaacaaaggctccatggacaagacagcaacgtgccgcacaataaagtattccaaagcagaaagctcagagaaatacttctttgtcctgccaccttgttcgataatgtgctggtcaagacctgctccggatacgccacgctgatggccatgattgtatttgggaagtggttcagtggttccaaccaacttggtcccggcgtgcttgtaggcgttgggacgctgctctttagcttgctcggcagcaacaattctgggtatgtcatccaatgtcaatgcatcctggttgccaaatgtcagctcggtgaccgtttccccgttggcatctctttcctctacaatctggaagccatgaccccgtgggtctgatccgtcgccgcccgatgaaccaggtcgtacgctacggccttcggggccgtcgataatgcgagacgcccgggccttcttgtaagtagttgagagggtacgctcattccggatggatcgtagacgccgcatttcgccgacagtttgttcaagtgaagacccctcttgagggctcctagtagcgtttgcgtacgatttggatcttgtggcagatcggcgcatttcgccgccaggagggatgcgaccactttcgttgccatcttgtgggggggaagcgtcgcctagaacatgagtcagaagaggttagagatgatgctataatgaggaagagaaaatatgaaaatcatgatgacataccagaaccgagacttccgcccgctctgagaacagcaagaagtcgcgcaagagcgaccttgaggagaaagacaaattgctggagtttcgtgatatgtgtaaaacccccttgtacgtcgtgcataagtcctttctgagaaccgcaatcgctacagaaggactgcttctccttgggattccacagggcatcctggagagtatgggacaactccttctggcatgacgcacaggtgagatgaggtggctttatatgccacctgctatcacccagcatgacacattcgtcatcgataggctctttgcaggccgcacaacaatcggaaagttgatcagccagtgtgtcgacaccggtcattagatcagcaagcgtctcttcttcaggtggcctgagtgtctccaagtctcccaaatggtctaggaaatgatgaaggccttgagaagcttgctgctctctctcaagcttgagggctccttgcaagccaatgcggattagcaacttcaggtaatgcgcaaggccggtgaccaaagacaggagctcctgagtgacgccgagtttgcggacaccagtttcctgggttttcgagagtagtgcgaagaacgcaacaattttcttgcacagaagctttgcttcacgtccatatgccaggtctggagagtcaacattgttagtttttaataatcctagtagaagtcaaagatcagttgttgcaacctacctttcatgccctgttccttgatatgtcccgcaagctgatcgatagccgagaacagaatatcaacatggccaatgaacctcttggcgacaaggacaccatccagatatgtgccattgctaacatgaaggagcatatctgaaatgcaggctgcggatgattcctcgaagctggataggatgctccatattttatacaccttttcttccattatgtcctcctcttcacgcaccctattgcgctcctcatccgtcgcgtccgtctcgacttccggggtttcaagaggctggccggtcggggccaaacggacattccagaacttgtgaatcatgtagcactcagggtgccaatgctgattctgtccgttgcggaagatctccacgaattgtttcaggattgctgtatggcaaccatggcatcgttgtgcaaactgtgtggaatagtgaaaatgacaataaactttcccttcatgctcgtagtatgagtcttgtgcaccaaaaacagtgggacaaacagaacaggtgaagtgttcaatgtgatacttgcgttccagggccgtaatatacgacccacgcagggcaccaccacattcatggcatagaagatctaatcgccgaaagtagtccgtttcacataaggggtattgaccactaccgtcttcggcatcaacagggaagaatttcgatgccacgatttggccgcagtcctatgttcaacagagttagctgaaatccgagtgtttccgtaagcctgtgtacacacctcgcacttgaaacactcgagatgatatgttgcttgcaaagcccgtacgaactggccagtcagtggttcgccgcacttcttgcagatccgagacgagcttcctggagattttgtcggtggccgaccattcggacgggatctctctcgtggcgtggatcggtcccaatagccattgcgatcccggggagttgacggatctctggggcccgggtgaccagactccagccgccggctcatacgattatcagagccttgtggcccctcaacagggctgttcgtggagccgttccaccctcccgtcctcgtacgaggcgagtcaaagataatattgctatctgcgggagacgtaggcgtttgcgattgatagctaccagatccatagccgctagtgttgagtttcgggcggacagccccgttgcccggcacgaggctgtccggcaaaggaacgtcgccgggaggcatgtccgtgggaaactatgcctttccgctaggtatctaagggagtaggacctggctcgacgggttgtatggacgatactcgagagtgtagatgatatcggagccaacaaggcgaggtagggccgagttgtagaagacgctggagggggaaaggagaatctagtgcggaattggagaaacaaaggggcgagttgtcaatgtcgcgcgtctaactaaaggacttgccttctgctgagtgtgcaatgttagcatagggggcaagcttccgggattcgttcgcgcggggttgtccaggagaattgacggctttcccgtagcaactcacctcacgccatgtagatgaaacctgcggggaatatcgatcaaaggtgtcggggcgcgtgataaaagtataaccataaaatcgcttcaaagtagcaggtgattttgaaaccgatttggggagagatgcctccaaaagcgcaaccgcccgcgtcgagggaagcggaatggggaagggttggagctcaaagtgagaccaacaggcggcggagtgcgctgtctggaatcacaaccattcctaatcccttccagagagacttttggtggacggcctgaatccgaggttgagggagacgggccggcaaagtagagcaggggaagtaggttcgggtcgagtctagaatgccagctcgagggagtgaaagcgagggcaggaaatcgcgtgttttgggaagagtgagtgtgctgctggcagttgtcgctctgcccccctatgcttcatgttgctggttgcccgctagagaccatcacgtgaaaggggtcaccgcctggcacaccgccagagaaggcgcttccatggctccttcacttgtgggtgtattaccagacagggtaaccgttccagagttcacaacagccaacatggaggttagggggaggcccaaagtaccccaagtttagtggccggatggaagaggttgtttcatgtcaaagtttatcttctataagctacatgaggtggttattatactatcaaacggacaaaacgctccgcacatcaactacttagactaccctcttgatcgtggtaattaatgtaggaagacaaggtactcggcagtatacctgaggtgctggcagaaacagaccctgtaatttccagggatgtggagacctcaggatcatgccgactgccatagtgggtagtgatggcaggtgaacggcatgtacgctgttgtgcatgctcttctctcaaggatgaacagagtcgaacccccctccccccccttctgagacatccctgggggggtcccttttgcgcatacctctcccaccacgcgcttctatttgggcgaacctcgtctttcccacgcggcttttgggtcgttggatcattccccgcatccttttctgcttcttccccttattcatcacgggctaaaaccactaactactatctaatcaggcaatgctaactctaggggaagcgggcgaatgcccgaccgctcgctattatacagaagccttacgctactatggttatttctagcaaacacatccacaccaatctagcatacgctgctttaccaagtgtgcatggagaattagctccttattcctccctttcttagcgaacagcagtcgctccatatgctagacataacaggtaaagatgtacagcgccatatttcttttcatcgattatccaccaacgcactgggcggagaaatctctgaagcgatgaagggtaaccaaccatacttactgcggatcttagagctggcatcttaattatagctcacactcatggtggtattgaattagaactccttagcgaatgcgtctcacgcttttacaaatgctccgtttaccctgacaaaggcatccaatgtggatagttctcgctttgataatggacaggaagccaagaagcctttctccaacgctgagagaaatgtctctgaatcaaatcccatacggctgacgcgaaatttatccgaagtgtctactaccccgacctcacttgcgattcctagcagttcatgcttctgtttttcgcatagtataaatcctcaagggaacaaggcgtcgttcattgcttgcgatatcatgtttcttaccgaaaataggcgtcagcaagattgcggcttgatacccatgggtctcgtgttgcggatttgcattcctgaagcattcccaatcctgctggtgtaccaccttcccagttgtacatggaaattcttgaaaggttgggttggcagcgggggtggtagctactcctcattgggcttgatactcagtactgtactccaaaatactccgtcggggtggcatcagaatcttcatcatggcaagcactgtcgatccagaaaagatgagatgtaaggggcagttgaaaggatcagcgcagcagaaaattcaggagccttgaacaacacgcccaacgtcacaagccaatcgaggatctgactgtaatgatattgaggggcttgtacgcggtgggttacgagattaggaggggttgggatagtccagtagaagaaagtgagtcggctagtcagagaaaagaatgggggggtttctttctaggtaaccagccatccataatcccatcccgccttgcctaaacgggcattagacccagggtcctgtcagtggtcggtcgcgactccaatggctcagtaagtacggagttgtgagaaatattttattttcagtggatgtgtttatttttgtctcctcgaaacatcatccgtcgaaggacggatccgtgtctccacctctgcgggcggtgagacagggggctgtttccatgggtcatggcctcagtccccttgaccaatcttgacctggcaagagtttgtgctagactgacgactaaatatggagtatcccgtcgatcaaaaatcggacgagtagtaactatgtagctcctatgtgaagggaactaatggaagatgcaacttgctggactactgacttaagtgtcctttctgtagctccaatgaatagtgtatctccattctcgtcgctctcgtacaagccatttgtgccaagagttgtgacagctagtagtggcttgcttcatcgtggtctattacctatcaccttggccttaccagatgctctgctaacagatgggtcgagtattggccatcaagtcatagaatccaaggcttgccgcagaggtttggaacgaggtttcgcaactgcaacatccactcaggtgaattggccctcgaacattgacaggtattaaatacgcaagtcagtacatagtttcatgcatgtactccgtagagccgtcgcatggggtattgttttttacatgcacctgagcatgcagccttctcttttgcctttgcgctagccagaagtactgcgtacaggtcagatttacgtctcttcgccagtcttgggtatcttcagtctgtttttactacgtgcctggagccgtgttaggaattgactcagactgatctcactttgatagttagcctgcactgcctggcttccccgccatcaactacattacgacgttgattgatcataccctccttcaacacgcttctgtctcttccccgtcgactgcaccttgattttttaacactcagcctagtgatcccgggcccccgtcaatctgtctcccattttggaccttctcggtcgtcaggatgtctgaccaggcgatcctgcgtattaccagggtagctagcattcctcaccgcattcttctaagcttcgctgggctaacggatggtcttaccttggcggggtcttaggaaatcaagcagattcagcaaggcgcagacctctgtgggtactccacaccctactaatagtaatcggaaaacggttccatcgaatccccgttgatggatagcaccggcttacaatggtctatggccttcgcattctgatcatttgcattagctctcgcagtatactacgatgattctgatatccggagtgtccgtgctctcattctcggccctccagatactccctaccagttcggcttcttcgaggttcgtttccaattcttcgataatatcagccaacttcacagtgctctgtgttgatctccagcatgataccctagtttttgatcaagttcggaaaaggtacattatcatcatctcgtgccaattcttaaatccgtggacaagtggactaagcttcgcagactacccggcgacatctccgaatgttcgcgccctgaccactaacggtggtcgcagccgctttaacccaaacatctattcatctggccgggtctgcttgtgagttgagcccctcggagttgtccataatgcctactaaccgagcggggatgatgtagatcgattctagggtacagatacacattcctatacatatcaactgcttgagcctggctgacaggcatctttgtagaacctggcgaggcgagagtggggagcaatggtcgtctgcgcagtgcttagagtctcttcttatctcgattcagagcttaatgtcgtctaacccctacgaaaacgaacccggatatgaaggcacacgatcttcgagtgataaagagaacatggaagcttacgtctccaaggtaacaagggcccagctatccttctaggtttaaaccattcttgaccagatctccagatacaccatgaaactctccgtcttgccgtccttgagcctcttgaggcatctcttaacatctcacttgaaggggatgcggactcgctagctgatccaacatctgaaggcgatgataatatcatctatgaggatgggaggtcttcctttgacccgttttcggattttcgcaaaaagcgtttcttgtggtattatgagccctacatgcaatcgcttgtcgctgcagagaagaaacactctcgcaaaaccaaattccagagaatgcctttcgagggtggcaacaatagtatggatggtcatttcgactatccggagttaagacggcggatggcggtggtcaaggacgccattcttcgagaaacacacggttgggctgtagaaggacaattggccaagaagcaagaatggggtattgcagcgagtctgcaacgacagtacgaacaaattgttgaaaacctcaagcatcagaacaacattacggtcgatctataccttgatgaggggaacccattcatgtggaggctcacgtactttggacgacccatgacgcaactggatggtggcatgttcaaggtcctgatacacctgagtccgcgatttccggaagaacagccccgtgtgtttctcgaggcatcgtctttctttcatattcgtgtgtccaaagagggagttttatgctacgttccaaggcgaacagaggaaatgcgctatcacatcgaggggattgtcgcatctctagaagaagaacacccaccctatgacccacgaaccacagtttgccccgaggcaaccaagttgttttggggaacaccggaagatcgaaggaagtacaaccgagaattgcgacgatcagtagagaggaccgtgtaagttcctatccacattggcgagttcacggacagtcgtattgacgaaaggatacagtgaaacatagcacgtctgagcctacatcagcctaggttagtaaattagtagagggctcaactagaacgtttctatgctgtgtcatgggacagatatcttggctacaatgttctggatttcgggcctatacttcctcactgctactttattcattctttcccagatcttcaagccgctttatcagcagaaaagggcaagggtctattcaccagggcttcaggtgtgctgtagcagctaagaagaattgaagaggagagttcccattcaattagtgcgtagtaaccattcagatctgcctccttgctgtaaccttgatcaattgtacgatagtggacgcaacgcccacaaagtttgcaatccagccccgtcagaagacgaatatgtagccagatcagacatgagatcttttcctggatggttggacaattaaagtagaaccaaattgatatctcggttccataaagtggaaactcacgtgtggcctctttgcggggggtccgagctttgacccggagattctgtccggaggcggaaaccatcgtcgtcccccaaacccgcaggcctcgcaatttctcctgtttattatctcttcccaaccaccgaccacggatagttagctctatatatatcacagcttactgtcagacttcacaatgtctactcgacgtcctacaatggaactgggcactgtcctagtggttggtggctgcgggttcgtgggttggcacattgttgatcaattgctcaatttcccttcggagacagaccccagtgctgctcttcccaagccccagaatgaccctaggttcgtttatcccaagctaggtgatcgataccctcggtgcatcgcgaaagtagcagttgtcgacctgcgaacgacccacaaccgtctcccgggagccgagtattatgatggcgacatcacgtccgaagagtccatgttggccgttttccgcgcggtcaagcccgacgtcgttatccacaccgctacgcccaacgttttggaagggaacaagcccttgttgcgtaaggtcaatgttgacggaactaaagtcttggtggaagttgcgggcggtgcccgtggtgactggggtggaaagtgcaaagcttttgtatacaccagctcgagctctgtcgtgcacgatacccaaagcgacctcattaacgtcaccgaagagtggcctctcatccgggggccattgcaacaagagtactattcagaaaccaaggtgagttatgtacccctattgttcgtatggcaggtgctgactgggattcaccctgttaggcggacgccgaagaactcgtcttgaagtataaccgcgcctctccaacctcgatggtaacatgtgcccttcgcccggctggtatttatggtgagaaggatacgaccttcaccttcaaggtcctggaacactcagccaaagcctccccgaccgtcctccgcatgcaattaggcgagaacaacaacttgtttgatttcacgtacgttggaaacattgcatacgctcatactttggctgcataccgcttgcttgctacctactctcggtatgaatctggacagggcgctcccctggaccacgagcgggttgacggcgaagcgttcaatgtcacgaacgattccccagtctacttctgggacatgacacgtgctgcctgggcactgactggcaaggtcgtggagcctcaccaggtgtgggagctccccgagggcgttctgggccctattggtggaattgcagagacggtattgggacttctcggcaagacacctcgtttaactagaagaacggttcgctactcatgtatgactcgttactactcatgcgacaaggccaagttccggctcggatatagacccgttgtacctgtgtacgagggtctcgctcgcgcagtcgggtatgtggtggaacaggagcgggtggccggtgaaaagaaggcattgtgatctcaggctagagtttgatggttttggtacggatgtatatgtttattaatgtaatatataagtaattcctcatcccatatataagcgcgtcctcccttactagttatccctgtgggatgggctctttaacaacttcagtgctgactgaccacaggcaattttgagctggccatgagaccaataccggctctctaaacctgcgaaacccttgaattgccgggatcccccattatcttccgagtgagatcaattgaggcgcctcgtatactccatcaacgctgtctccttggctccagccacgaatggtactcaacaaagtgttgttaaaacgccccgagcaaattatcctacttcatttcgactcctgccgaataatatgcccgaagccgaagatacggtgtagcatttcctcgatctttggtccggctgttgagttaacgatgatccacaagctttctcgacgcaatttagaattcattgatacttgtcggaaacgatacaatagatgagtattgaagctttgccccatttcttgatcgcaggaccgaatgggagtcaagtattccagtttctaaagctgtcccgtttgcgcaaatcgatttaatttttgtcagatcgattcccattatcctgtcatacattgcatctttgtttggtttcacattctgcgccatatcatcgggtcttttaccctctctgctgggatgcaagccgaaagaaaagttagggtcctcatgcgaagaagtggaaaccaacatggatgcgaactattccttgtgatataggtgatgatcgtcgccatgggggttagtcgtctgaacaccacaacatcatcaacgacgggtttaacaagacctgcaatacttgaaagaaaggggtcaaagatacttgcctcttggcgtcaatttgcaatgcgctttatgtcgtacttcgcaccagctcgttggatatttggctctgagaatgtgctgactgtcattgttctcgcaggtataggtgccatcggcatcttgaacaacaggcataatgctggtaggcgtgagcatgctatacctggtttgatcgataccgttcattggtcgtcagatatcactgcatggtgtaggaacaggtcattacgaactattagcagtatgtagtatattctttcctcatccggcaggaaccaatagatcccccactgtgatacaactgcattccctccgaaggtactgcgccgttctttctggtcatctcgtccattgcttttatttttgaggttttaaacatccttattctgtgggcttcagtgggatgcagcgctatgtctaacgatcaggatatgcctcggatgcctcaaaggcccgtacttccgccgaacgcctgctctcatcaaacctgccttggtcggatatcttctcttacagcctggatacttgtcctattggcctttgctaccactactttaggagcctcgggagattatctcgacgacgccgagcaaggtgttccggggctagatgcctccttcgattatgtggttgtcggtgccggggccgggggtttgactctggcagctcgtctagcacaacacaggtacaaagtagctctggttgaggcgggagacttctacgagttcaaatatcccctagctgcggttccaggagccgggatcataggaatagggagcgatgtcagcagctcgacacccgtggattggcggtttgtcgcctacgctgttccgggagccaactatcgcgacctgcattaccccagaggcaaatgcctgggaggatcgtaggctcacttctcctctcactttcgtcggtgcatttccagatggccagcgctgattcttccgaccttctacaggacaggctccaacatgatggtctatcaaaggttcgaaaccactcgccgggtagttcacggagggcaggactgatatgaactggagctagaccaaacaaggaggcaatgcaaaaatgggcggagctcgttaacgacgatagctatactttcgaccgagttctccctttcttccaacgcacggctaacttcactccgcccaacaacgacgtacggaacagcaacgccacagcatctttcaaccagggtgcgtttgataaacggggcgagcctctgcaagtatcgtaccctgagttcgccgtaccgttttcgagctgggtgaaacgcggtatggagtctgtaggcattcccgagatccaggatttcaacagcgggtcactactgggcgctcagtattgtgctctgactattgacccacacaagaagatccgaagtagttcagaggccgctttcaagagctctccaataccacgcctgatgactcttgcggtgtacaaaaagacaatggcaaagaggatactattcaacatagagaggcgagctaccggagtggaggtcagaacgggaggttcgaaatatatattgcgagccacccgggaagtcatcgtgtcagccggggcattccagagccctcagctcctaatggtatctggaattggcccggccaatgagctgaaacagcatggtattgagattattgttgaccttccaggagtagggaaaaacatgtgggatcatgttttcttcgggcctgcgtaccgagttgcgctcccaacaagcaccaggatcgctaccgactttctttatttgactgaagtgatcgtccagtatttatcaaatcatagtggtccactgtcaacccagggaattgatttcttggcttttgagaaggtcccaattgaactgcggtcccacttctccgaagagacgatccgggatctatcttggttccctcctggctggcctgagatagaggtacgctctctgcacgggaactttgagcatggctaacggtcaaccccttgaagtacatcccagtggctctctatcttggggacttctctgatcctattaagcaccaaccgctagatggggcacagtatgcatcaatcgctggagcattagtcgcacccacatctcgcggcaatgtcaccatcatctcagacgacacagatgacctgccgataatcaatcctaactggcttgcaaccgacacagaccaggaagtggctattgctatttatcgaagaaatcgcgagattttccatagcgcggggatggaaccgattattgacggggaagagtactttcccggtgaagaattgcagactgattcggaaatactagaagtggtcaaggacacacttatgacagtctaccatgcttcatgcacgtgcaagatgggtgttcgcaacgactcgatggctgtggttgacagccaggcacgagtattcggagttgatggattgagagtggtcgatgccagtgcgttcccaattctccctccgggacatcctcaatcggtagtctgtaagcagcctatagttccagattttcctctgattcgctgctgacagtcttagacatgcttgccgagaagatcgcgtcggacatcatatcctgggactgaaatggttcgttacgtgttgcatttgtcattatcattaaagtaattcttaataagtgtctccgttcctaccattcttcgtgcgcttatgttcagaactgaaattcatgtctactattgttaatattaaaccttctttcatgttaatatcattaagaattcgacgcggagggaatttcctgcatcctgtaaactcaatgaagctattttccacatgatcctcccagaatcactctaaataattggaccacccatgcatcgcataaacgcataggcaacccccaatgatgaaaccatgcttcaacaactccaccctctactctaaattctgtaagatacactgacctccccggatgcaaacacaccacaagagtggaaataactccgacatgatccaaccgccttctaactcccatcgaaacttgatcctaagattgactttggaaactatgagtttctacaaaaacatgtatatctcaaaagtctgaaccttgccttgattactgatttatctacctagtacttacaccaaaaatacattccccccataccagaacgaaatccagaaccttccatttccatccataccccgacattatgaccatcggattgtcgtactctatccacccgcaacccccgcccccttgcaaggatagatatactattatgattctttcgtcttctccacccccatgcttatattatatgtatatgtatatgtatatgtatatgtatatgtatatgtatatgctgtgataggaggggtggatgatgtgtatgatgtagggggctggggatggcaaatcaaacatacatgcatacatacatatatacaaatgtacacaggtgtgtgtatgtgtacgtgtatgtatgcacgtatgtatgcatgtgtaaaatgcatgaacgaagataggatgggatggggagaattgggatatggaatatttattggagggggggcgggagggggacaaatctcgctagggtgtgtccgtctgtctgtatgtattttgtatgtactcgctacaaggaggagttttggtctatgtagatactttggatggatggtaaaagttggagtggttagtgtgttgtttggtgaatggctgctgctgctatggtaactagaacctacccatctaggtactgtggtatggatgaatctctacgaaaagtatatgggggttactcgaagggtctagattcctgtgtttcggtgtcgaaagtaaatttggagatttcgggatttatcacaaggtagtagtgacatgccattaaataattccttcctggatatatatactaggtaggtctaggtctagataggccacccacttgcttccatgttataggaaagatcatgccatgatgagaatgcatagagatttaaaacctgtatgtgtcttttacatgtaggtcgaggcttgctctcggagatttcccctaggtttgaatagagagctttaatagatatatatttctccccgtgcgaatcaatgatgaggtggtagcgttccaggtcctttgattccgtggacccctttcactttgtttttgatttccaatccaggtgtcttgctagtttgggtaagtactaggtacctcgtgaaggaattcttggttttagaggcggaggtggctgaacgttaactttgttggtttggtttgacacatttcaacattgggagtaatgtggtatgtgagcaaggttagttactggagtgacggactgactgactgacttttcttcccatgcttctctgtccgtatttaggttgggaaccccctgtcagatgatctcgtgggatcggccaatgtccgtccatgcgggtttgtgtgcggggatgggggatatggttgattagcttaagggaagaatcgtggttagttagtagtacttttgtacacactctctcatgctttttgttcatgttttgatgatctccacaggcaagtacatttttgggttttatgggtgtcggcttgtatctaagtgttttagacagggaggaatttgtgtgctgagtgtggggagggagttctctccaccacagacaaaaagccgatcattactcttgttccacctttgctttcattctccttggccccttcggtaaggattgacagtggaatgcagtctcggatgtgggaggtgcaggaactcccatcgaatttcatgtacggaggccggacgtgcctacgccacctgcagacggttgatcctcacagttgagggttggaagagactgggacccatgggatttggatgtttggctgacggcgatagaatcattcgagaatacgaccagggatatatggtcgtcattggcttgtagcgatgtccaggggttggggggtcctcagggcgccatttttgagattttgaggcattggagatgaaacggggtggatcgccagccagcgcatcattgtcatcatcatgatattattgcgtagccatcaagcagagccaaaggacgttactggtctgataggtgcagcaggaaagccaaaggcggactgaaaaagaaaagaagggggagggatcgtttgcggtcatggatggcttttggtctccagccacgccgtcaatcagctttggaacctccccacctggattaccccgcagaaacatccacctcagcttctatcatataccgattggtgtcatcctccatcggggagtacgtggaagtagtcctgatgacgaacgatcctggttttaccattttcgggtcataataggagtgacgtgagtagaaacaatactacctcagtaccgatctgactgctaccggtcaatctccacacaaccgcagaaggggtaacaaaccgatactgctaagacggtatctagtggattccgcaactgagtcgagcgaatgctcggaatccagggctgagactatgatctgtcacgggccaatggccgaccgcagcccggactgtgtgtaactgcagacatgcagacagcctgcctcgcttaccagcggaaccccagtcagtttagcaccagacgcaccactctttgagatgaatccgggcttctagcgtccctgtcccggatcgaatgatgtatctcatgggggggcgaaggggagtcaagtgagcagcttatccgctgggtctgggggagcttgatccatggtacagcggacgcagatgggagactcttgctctttgccattaataaccattatggttcattactttcggccgggcggtgacgttctggtgtagtcggtcgaccctctgaatttattggcgcaaatgggacattgcaggcaacacacgtacgccgtcggtcgcattcacttgtagggatccttttcgggggtccaaaacttcgcaccagtccggtctacagggttgtctagattgcgatggctgcgagttagggagcgaggagggtcttgtcggttgtacgagaatttcgagaatagaaacccatcgaagagatgcgccaaatggaaatggcccgaccgttgagacgggggtctggagtggcgcttcgtggctgcggatactgtcgtgtgtggttcggaatgacctccctccagaagggatcgagaccgaaagaaaagaagaaaagcaattccgctatctaacccacgggaaagtacgaggtctgcatgctgcgttgtctctgaatggagggggggccactgatggttcctgggtgatgatgacggcaatgatgttaatggcgaccgataatcgtcaggccacaacaaatgagagagcagagcattctgaggaacgagccgtgtgctgggattgttcaatatctctccaagaatttaatttgttaattgaggggagagagtgtgtgcagcctccgactaggattaatcactgccccgttgctagagtgaaagagggagctgggggatagccagcgaataacagacgtatggaagctgtccgtcggataatgtcgaccataataccagcagatgatgggcggttctggcgcaagttgaagcagcgcctagataactgtgcagctaggtacagttaagtggatgtagctagtgactagatgcctataccacgggtgtgtccgggcatccaccgcggctcctctgagaggtctagtggattgtgatccataccctaatgcaccttgcagatggagccaccactccttagccagcggtaagaaaagccggacggaaagactttaagactagatgcaccgtgtgtcagaagggaaggtgaggtgagaggaggggggagaagaagagacgagagagaactaagagacattaattgcatctgccggtatgagagagagagtaacttcagtcgcagtgtatttctataatacaaagagtagacggcaataattctcaatgcgaatcatgttatctactccgtagtaactacaaagtattattttccggttggaacggcttctgactgtctctccatcggcagtcagaaccagacgaccaacaacctcccctgccatttggagctacgatggtttcaggcgggaaacctaaaaccccatttagattgtgtccattcaaccgaagactttcttgagaaagtggtttggctttgaaagtcaatcgttgatcgaaagtcttgcgctgctgcttttcccgccaaatttaccataccatacggtaccgcacagatccgcagccaccgttggcgccgtgtgatttggctgtgtgggtaccaaacgggtaaagactggtaaacttgccgtttctcacgttcttccctccatacaggaatacaagaatagtacgacggactgacgctgccattcctgaggttgcttgctggctggctggctgctgtcttcccactcactcactctgtgccttttcccatctatttttcgcccttaattcttgttcgtctctccatttccctccctgttggctctctccccctcccgctgctctgtttattctatgtcgctattgctccagagctgtctggtttcaccaaccccgactattccctgcttctagtcgacctcgttcgggggttgacttggtcaaatcgtcaccctggcttcgcgttgacgctccgtcgcgccattcccccgcatagccgcttttccctcttcgtttcgctttcctcctctgtccttacgtgatcacgagatcctcctcaacttttttttttctttctttatctacagaagaaaagaaatacttcgttctctctctatcaccggaaaaacaaatagtgcacttccccgtctgtctgttgcgatagggttgtttgctgtctcgttatcaccgtcccccgctatccagccatggccaattaatactgcggatgcattcataaccaacaatcaaagggcacccgctctgcctggcagacggtcctgcttggaagctgctcattgtgataatctctctcgcttgatctcacaccccacgcctctcagtcattcgaccttccctcgtcctcccctcggggtagtcttcggtattcctgtcggctccgcctgtccagcatggcgggcaatggcacagatgatgctcagtacctcgctcctccggccgtgactgccctacggcaggaagctcggagtatcgatccgagattctctcctactcgctcccccagcgtcgatcacatgcgacaggaacgtgaagatctcaaagaggcggcggaacaaaccttgaacgtcattgttgatttggatctcgatggtcgcgtcaaatgggtcagtccgtcatggaaacaggtcgtcggcacgtcaccagtatcaatagaggggcggatgatatcagagatcgtggtcggtaaccagaatgtctttcacgatgccatagagagcatgaaggaggatgactcccgcagtcggtttattcggtttgcagttcatatgggccccgattcggtcttgaagtactcgccagagccacgacctgcggagccagagcatgaatctactgaaacgaccgacattgcagaagaagcacaagcccctgcagaggaggaccgccatcatgacctccttcatctggaaggacaaggtatcatggtgtttgatcggacagccgatggagttggacatgtaggtcaccgcaattgtcgatgctcggtatacgtgatataaactgaccattcttttctacattggcagaccatgtggatgttgcgaccgtttacggaaccgagagaagtcaccatcgaccttccgcctttgctagtagaatccttaggcgtcggagcggaagtgttggcaaattacttgaccactctggctgaggctgctgctagtgagcctgatccttcaaagcatccagctccgaatccggtgttgtgtcgtatctgtgagcgacagatcacaccatggtggttcgagaaacattcggacctctgtctacaggagcatcgggccgagatggatgttcaaatagcccaggagaatctcaacgagcaccgtcatgccatcgtcaaggtgctagatgctctagaggccagacaaagcaggccgttggtactcggagagagcaatcccccgccaacaccccagcccgagtacaaaggcctacctattgggccatctccagtggcctccgcaccgtcgtcaggatcagtctctagtgctaattccgctcctggcacgccacctcggtccagagatcattcggcctcaggaatcgggcatactcgcgctcgatcattcgcagtgcggcgtccgttagctcgcgtcgttgagttgatccttgacctttgtgacactgccctagaaatcaacatgcctatgatcaaggaatctcgcgcggacaacagtgatgattttcggacattgtcaccgcagtccgaatcccgtatctcgcaggttctccagtggcaatcacccagctctaatacactagagcaggagcaaggactcgcggccctatgcaacgataccgaacaagtcgccaaggcaaaagttgatgcggttatccgccatagaagaattgtggagtatgctgagcggattcgcatcgaatacacgattctggtagaggagtgcatcaccgcagctctcaccaaagccgagcgaattgcggccggtcagctcagtgattcgagtgcctcagacgatgacgccccccaagacaccgaacccgccgtgaccacaagtagcccgataatacgagggaagcgcgaatctgcagcaccgcctacaatgtccgctttaacgatgtccatgcgcaattcgcccgaccgattccagtccagccactcctccgaaggcaaagcctcagtcgctgtgtcgaccgggtcgaacagcccaatggaatgtcccacaccccgatcacacaagagtatagccggcgttttagggacatcgcagccatccagacggggtctctctttgatagatttggatgccggcgattacagtgacagcagcgctccttcttctgcttttcccggtgccgtgcgaaccgactctccctcgtccgaccgcagtatggacaggaagcgaaggagtctggtccttcccggtctttctagctcacctcgcagacaacattctccagccaggatatcggggccacattcaccattacgaatgccccgggctcgtctttcgagcggcgccgatagtctaccgtcacctatagtatctccctctgcaaatgcgatcgagctggcacaaattcactaccctcatcatcgccgtcaatcgtccgcaacgtcttccgatatcgtaaagccgcccgtttcacctcatctatcttccgccagccagccgcagccgagaccagcaccgccgtcgatcaaggactttgagatcatcaagccaatcagtaaaggtgcctttggaagtgtttacttggccaaaaagaaagtaactggggaatactttgcgatcaaggtattgaaaaaggcggatatggttgcgaagaatcaggtcaccaatgtcaaggcggagcgtgcaatcatgatgtggcaaggcgaaagcgattttgttgctaagctctactggacattttccagcaaggactacctttacctggtaatggaatatctcaacggcggcgattgtgcttcgcttgtcaaggttcttggtggactgcccgaggactgggcgaaaaagtacattgcggaagtagtccttggggtcgaacacctccatggtaggggtatcgtccaccgtgatctcaaaccagacaatcttcttatcgatcagacgggtcatctcaagctgactgatttcggactgtcacgcatgggccttgttgggcgtcaaaaacgcgtcctcaagagtatgaacaatgagccggcacccgatcttctgaaacagggctcgtttcctcgagcaacttcaatcacatcttccagatcagcctctttcgatttccaaggcagcggatccccgggatccactccgttgatcacgccagatgttgctagtagcattccccaaccttcttacttcagcctcaaccaaggtggcggtctcagtcggcagacttcacgtcgagcgtccggctaccgtagcgatagcggcgccagcgagagtctgaatgccatgttccgcactttgtctatcaacgagggtggtgaagcttccggcaccatgcctgtgcccgtcccttcctcgggccaacaccaacatcaacaccatctacctgaagaggaaagccagagcgaggcgggtgagtctcctcacttgtacccgcttcaacccacgatgagcaattccttctcctacagcactcctccgcaacagtcaatgatgcctcccctaatggcgctgtttgaccccgaggaccataacaggcggtttgtgggtacgccagattatctggctccggaaactatcaacggtgttggtcaggatgaaatgagtgattggtggtccctgggctgcatcatgtttgagttcctcttcggctatccgccattcaatgctgggactccagatgaggttttcgacaatatccttcaccggaggatcaactggccggacgaagccgaggaattcgcatcccccgaagctattgatcttgtgaacaggctcatgactatgaatcctcgtgaacggataggggctaatgtggatgagaaatacccaaatggtggagcagagatccggagccacccttggttttctgatatcaactgggataccttactggaggacaaagcgcagtttgtacccaacattgagaaccccgaagataccgaatacttcgacgctcgtggcgccacgcttcaggcctttgctgaagaactggaagatgcaagcccccctcaaccgccgttaaccactggcgcataccctcaagatcggcctcatgatgccttgttcaaagtccgctctcatgttaattcgatgaagcgaccgttgatgcctctacatattccacctcatgtgcgtgagtcacgtagcaggaggctgagcgagcctacaatggccgacgattttggcaacttcgccttcaagaatctccctatgctagagaaagccaacaaggacgtgattcagaaactacgccaggaggcaatgcaagcacagcaacgtcacgttcctcctacgggctctcagcaacaagcacatgcgcaaggcggccaggatcaagcccccactcagcctgcaccacccactttggagggaagcccgttaccgatgtccctacagcggacattgtctcaaaccaaaggcaacaaccgacctgcgtccccttcaagcatgagccaggcgaattcgtctcccagtcgtccttctcaaccctcgtctccgcttcttgttcaatttagcaccggtcaaaatcacgagcgcagaaaaacgtccgggtcatcttctaataactcgcagtccgccggaagctctcagcccgcaagtgtcgacccaagccggatggcgagtcttaagcacggttccgcctcatcgtctcctataaaaccccctcgggccacggctcactcgcctgacaagacaccttctggacagcgccacggcagtgctcctgcctcacgagcaagatcacagaccatcggctcccaggacggggacctctcatcatccctagccaaggaaacatacgccgtgggccactacaaacgccgcagccaattattcgatatttcgccctcctcgtcagacaatgaggatccgcgtacgaaagctttgcttaaagtacagcgccgccgccaaagctcgaggcgcatgtcacagatcaatttccccgatgggccatttttccggcctttggacgtgctcatctgtgaagatcatcctgtttctcgcatagtgatggaacgcctctttgagaaactgcgctgtcgtaccattacggccgtcaacggtaacgaagctatgcgttacgctctcagcgaggtgcagtttgacattatcatgacggagtttaaactaccccaggtaaccggcgctgatgtcgcgcgtatggtgcgggaaacacgtagtgcgaatcggcatactccaatcattgcggttacaggctaccttaaggatctgccagaaacccaccattttgacgcgctcatcgagaagcctccaaccctaacaaaattcacggaagcactgtgtaagttctgtcagtggaagccgcctccaaaggactacaacccttcccagtcaatgagtgtcccgccttctacgatgcgccaggctttcgtgcaagccgagcatagcccaagttcaacagcctcgtcggggttcgcacatgtacctcctagctcttacagaggatccagtcgagaggactccatcgtcagcagttactttggcgatatggagtcaatcaaacccgatgacggccctgtcatcgtgagtcatcacaatgaagaatcggaacaggatcaaggtggcctcgggatttctgaagatgtaattcgagtacaagaaacgacggatggcagtttcacatctggctcggatacagtgcctttcccaagcctacttcacgcctcttcagcaccacccaccgtgcatccttctggaaacattacacctcgcaaacagcgatccactgaagcgattcgggcgaagagagaatcgctggaacgcaagcgctacgagtgtgccgagtctggcgatgatgaagatgaagagctcggtaattctcaaacacgatcaagcagcccccaacaaagatctcgtcgtcctggctctaagctaggaatagagatgatgagaaccaatagcaggggcagcgttgtcagtggaagtgaggagcttctcaagagagagagggagtctttggagcgacggagcagtggaggttccggtggcgccagtgactacagcgaggaacgtactggcactcgctctccgcagagtccaagtctggagagccgcctcgagaacctttcaattcccgaggaggcgattgtggggtccgttgaaggatacagccctaagcattcgcccatcgtggagctagggtcgaaaatggacataccagcaatcttttcagatcggtcaccgtcaccgtactcggcagaaactgcttcgggtgcacaggctatggaagacagcgtcgaaacacccaaacttggacatattacaccacctattgtttttacgagagatggagagtctgagccctcaggagacgacccggcgaccccttacttcaagactactggggacgattcagctgcgaaatatggtgcagaagccgacaatgaccgatatctggatgccgatgccacgcctcgaccattgcatacaccatcgccccatccgtacttgggttctgcccattctcaacccgacacataaagaaccgacactatcttactttcaagatagaccttgcggaactgcaattcagtgagacatgcgttggacagatgtccacgtacggtccgctattgtgtgcgactatatgacttatatcactgcatgcttacgacatattgttctttttgcacctgttaaaatacattcctcttcttttactgccgatcatattgctttattttccacgcgcgtttcaaggctagcgggtgtttgggagtgtttgtcgtctcaaccaggctgtctgagttccactcttttgtcgatttcccgttctcactttcatgtttttattcattgttccacttgctcatcatccatgcgtatatcccatttcctttgttctgaaattttcctcttctgagagcaaaattgtgtgtgtacctatacgtaccagtttctcaagaaaaaaaaacagagtccatctaactgttttgcactagtagacataccagtccaaatgtacaaaaatatttgcattaatcctgtttcatcttatatactcctttcgacccgttgtaaaacgtgatttggctaatttgcttcccccgttctaattgatctttgtctgatccacatagcggagaacggagtactagttcactctaacccctcccttccaaagagactcttccaacatgcactcaaaacacccatccaactacccaccgactccttacatactgaacacatgcgctaccatcttgcctcttcgatacacaatctcagcgagaaactccaaataattattactgaacgtacctccagaattaatggagaaccacaagcccacccacacactccattgagaacaagcgagagaatgtgggaaaagagaacatgttacgagttagtgtatttgggagtagattgtatgaattgcttagtgagtggtaattagtttagcttggatagctcccctcactaatgataattagacccgttgttgttgttgttgttgttgttgttgttgttgttgttgttgttgttgttgttgttgtttactatgtactactaaaactgggttgttttactgttgtcgtaggtgttataattcggttggttggttggtggtggttgttctggcagtcagttttgaaggatagaagggctcgtagtagtattatgacagtgcgcttaggactagaactactaaacaattttggctaagtagtgcatatcattattgaatctatatatcgatcgaatactatgccacagagaaacaaaaatctgacaccggccagtgctgatttgcataccagccacacaacaacattagtagtctagtcaactgaatatttcgaccaactaaccgggacaacgtactgacagctgtccgtccagttattgatgcagaaatagaaacacaaatgccaccgtttggtatgtacggaaaggtattatctatagatagctatgctgatatgatcaggacaaatcactcaacagtatgtaaaagagacgacgagcaagtgcacaatggcagtcatttccagcatgaacaccgcactgttgaaatgagatcatttctcgtccatagcgggcgacacggcgcggatctgaggcgactgctggccatgggattgcccttgctccagatcagctgggtcgcggctgctgatgctgttgcgatgacggaagaatcggccgcgactgacagaggacaaactgtgaccaccctgggattccattgactggcgaccggagcgcgccgcagacggggcggcgctggtgttggagtggcttcggcggtgagaggtagatgcacggctctgccgctcggcttgctcttcctcttcttcctggatgcgacgctccgcggtttcacggttggccatccggacaacgtcatccacacgagtgcggcggtcttcaaacacatcacccataacgtcgccggaagaaacgtcgcgcatgcccagagagaagtcaacatgctttcgcgtgagcatcgagtcaccacgggcccgggcagcggcggcgtccgcgcccttgcgaaggatagaatgctggcggacagagctgctagtgcccatattttcggggagcgaatcgtgctggtgcacaggggtgggaggaggccggccatcactgctgccgggaggagcgcccatgttatgcgaagggaacccggcgacatggaagggaatgtcgacacgggcaccctggaggttcatgcgtgggccttcgatgccaatctcttgcaaggcaagcatcagcatgcagatgaacttattgcgacgttgcaaacgcaagccctcattttgccagttggacttgtagaagaagacaacattgagggtgactgagaagttttcagtcacctcacgcatctcagtgaggatgttagtctggaattcgcggcgttcgctgcggacaaattccaacaaccgttggcgaagaccatcaatttgctcgagtgtcgtgccatacttgatgacaataggaacagcctcggccagggcacctgatctgcgctggttgagaatgaagagaccgttcagatagctgttcggggcttgaacaacgtgaccctgcatcttcttgaactcggtatacaagagggaaatctgcttgacgaagtagtcatcacccaggccggaatcacctgagttaccataaactgttacgcggtcaccaacatcaaacgggtgcttgatgaagacgaaaatgaccgactgaaggaactcctgtgcagtggcagagaatagccaagacaacgcaaggatactggagcctgcagacgtgagtacgccggcagccgaggtggaaatcagggtcaagaaaacgatcagggcaatgacaatcacgaagaattccagtacgttgtcaagtcttccgacaacagagtcaaggtctttcaaagacgcagtgatggctttgcgttcgcgtccgatttccacgcacacagactccaattcctccattgaaatatctccgttcatgtccttgtcgaacatggtaaaggcagcttcggcttcgtcattgttatcaaacgcctccttcagatcgccagagaaaacggtctcaaagccatcccgcacgagagtccggtagagtcgccgagccaaaacctggcaaccgctcgtggttcgcagcaaagccagcacaacctggtaagggtggttgctgttggtagccgtacgaccagtgaagtccgctgcaactgcaccagcaacatcaccaaccttggtgaaggcacccttagcaagacgccccgctttaccagcgtagtggaacgggatcttgaggccgttgttagagccgggctgcttttgctcctcaaattccttgtccttggcagtaattttcctccgcgagaattcgtatagtttggtcaagctgccaatctggaacttgttgatctcaattctatcggcataagtacgtgtgtggaagctgatagcgatcagctgaataatgaacttctccaccaggttgaggatcgtccaaacgaagacggaaatgatgatcttgttgagcgtgttttcccaggagcgcgtcgtatggtttccgtccacgtgatgattcttcatcgtagggaggaaagaaatttcgacacccaaccaccagaagaaaagggtcgcatgcagttccaattgcttggcaagatcacgccatttctttgcattgttggtaaagatactggcgagcgcattcacaggtataggtattaacttggaaacaatctgccaggactcgtatcagcaacagggcaatgggaaacgggtgacgatatcaggggtactcactcttccagcccacaatgtcaaccagacaatttccaaccagacagaaaaccagaccaaccggacacctccgacactggcatcaggatatgccagcgcgccaaccaacaacggaattaataggacgatcacaaggggcacgatgtaggtaaggtaacggatgatgaaactagattcgtggagtttcttgacgaatctggcaatgttggtattgggattctcgggtgggttgtagactgcagctttctcatgcagcggattagtggcctcatcaaactcgtcgacatgttcgttcgggcgcgagcgagaacgtgaacgagagcgggaggtggatgtacggccgccgttaacactctttttcgactctgcctcttgggtggagcgcgaaaccatccgttcagcctccataactgccaggtcgtcttctagacgcgtagattcttctctcgcagtgacaggagaacacagggcggtcctatccaagtcattgtaagaagtgtccaccctcaggtggtgtccattactagaactgtcatagacgtaggttccttcgtcagagtcaggagtgccatcgtcgtatctgtgcttgctcttctcttccggatgatcaggagaaagatgctctcccatagaggtcgacatgttggcaccaggccaggagtcgaaagcgaagagctagattacaggctaaccagcagtgggattatagatcgaattactccggaacagactagatgctgggtacgttagacgggaatcgatcaagaagaagccatgcacaagcttaatcacgagcacatagtgaagaatgaagaataaaaaaaagtatagacaaacgaagggaaacacctggaagataaaagagggtctggtgcaagcgagaaagcgcacgagcaagggcgaaggctgacctacactggtgggaattccttccgaaaaccagcaaagctaatgatgcattgactctggccggtggctcaaaaaggaacgggagataagcgggcactagtaggattgtgcagatggaggaaaaggaaaaatgcacagaagcaagtagtagagggaggaaagaagaaaaggaagcgtaatgagtagaataggacagcgtgtaggtggggagcccgtgaaaagaaaagagagaaagaaagaaaggaaaagacagaaggacagaaaggtacaggaccaagtgagactggaccttggttcgacaattcgacagcagcagagcagaaggaggaggagatcgatgcgggcgagatgccgatcgcacgggacaatttaaccaactggagattcaatgactgaagtctgaaggtttggcaaagtccagaccaattccatcctcgagtcagacttcggttatacacatgaagtcttcctccacaccatttaatcgacaccatcctatgatgcctttttacaggggacaatcggtaatatccgtgttagatagaccctctacgtgggaataatctcagccatccgccttaaacaatggtggccgcgggtggcggtcattcgacgatccaagacctcgatcgatatggatccaagtatccagtgggcgtgcactcagcatcggttctggcccagtggcacccagtgggtccgagtcatctaacgttagaaacttcaaacgggtccaaagaaaactctgggacccagagtacccttcatgctaacccaaactacctgcgttagctcctccatcgttgcagccttagtctggtgtctcacagcgagactgcgttctctgagaagggggggtcagcttggcatttcgcgggatttggtcctgcagcgagcttacagagaggagaggggagattattcggatttatgtaggaaattcatctcgctttgcagatgcacaatccgcggatttgatggggtgggaggtttccagacagatgtcaagtctggaaaacagaccaaatgatgttatctcatccagcgattattctccgaaagtcttgaacacaataataaatgtggaagactggaagggcaaaagtggccaccgccaagaaacgccacctcaggcactcccggctgtcctccagctgtgcacaacgtattgcacaaaagtcatcgtggattgattcctgggtcagcacttacgtcggagaaccacatctcggaaatattttgccccccactacgcagaatgcccatgcttgttgcccggcctctatacagttcgtcaaccccccggttactgtccctgcagattgttgtaatttgtatcccgctaccgttccaacttaaaagggatattatggtttgtgaggcgcgagtcagtgcagtctatagctttaacactagtatatggcgctaagcctggaggattccaccatagacaccatctgagtcttgacgtctcaaaaacctgatttctacacgctagtgttttttccaagcagccaatccttcacttcagtcttagatggatgaatgagaccgcctcttatgataggtgacaaagagggacgcggctaacctaccgaaaaattatacctccccagcatgatattcggaattacaaagcgccatcctgataggcttgtgcattaggtaattgtatgcgcatacttcgttatgcttctgcttgcctccatcctccattatctgccacttccactcaccccatcacattttcaaagagctgatctcgattgggttatcagccctcgacataatacctttaagcacgcgaattccattggcaggtccgctctcggttgttgacgtgtcttgccccgccatgtccactgaagatctcggcggtcatctgcacggtagatgggaaggccatgataaccgtaaatggaagcttatgaattatgcttacgaagctcgaatcatcgaagcgcaagggccatctcggttactctgtaaactgtagtatggcatccatcggtaacggtttgccgttctcacaacgacttggccgcattggttcccatctacctgccgggtgttcaagtgttccacaatgctaaaatacgaaccaaaatttgtggtcaggtcattgttgactagtagtcatcgtgcctgtctgcctgttttccggctcttgttagtccatgtaaaataaacaacatgtaggtatagatgcgtaggcatggtgtaggggcagagtgcggggaagatcgacactaaacagtttcaaactatctcttccatcagatttccatattgtgcttactcgcccctctgattagatctaccgggtactccatacagctaaatattgtaaggccagcaggggcatcgcagctacccctggtctgtgcaggtcaaaccgctgtcacacatcacgaatcccaaggacggcttccccgcattccacggcagagggcacgtggagtatggaggatcccgctatgacaggaaagagatgtaatagcttggaaagaactccgcagttgatagaggacaatttcgtgattctctggtgtatcgaggcgccaaaacattagcacccggttctatgggagggaaagagagagagaccaagtgaagttcacgtgctgatcgactgatcggtcggaagcagaagggccgctgattggtcgaaggagccttgtcttgtttattggaccggcaagaacaactgatgctctctctttccatcctccttcctattgatccagtaactccctcatcctccatctctttcctctcttcttcttccatcatcctctgggagttcagtctactgcttgtcatcccagactattgaccattatccagactttgctgagagaatcccttgcgtttgtttacgacgataattggatccattctccaacatgcgaggcgaagtataccccccgttgtatttacctttggacccccgcaccgtcaccccctccccttatccataaacagccattcccacaacctcacgtaccagcactcattcaacttcctcatcccagcttgacttccctttattctaactatttcgttccatcaggtctgccacatccacatcggccaggctggtatccagcttggtaacagtgcttgggagctgtacgtcctcaccgctttttattgtaccccgatatatatgccttcataggtgatttcatgctgaccgcggccatcaccgcaggtacctccttgaacacggtctcaaggcagatggccagctcaatcctgaggctgacgacgcaatcaattctggcggttcgttcgaaaccttcttcaccgaaacgcacagcggcaaatatgtccctcgctctatcttcgtggatcttgatccttcggtacgactttatccaatcaaaatggcttattgaatgtatatggtaaactgatggatgcagcccgtcgatgagatccgcaccggccagtaccgtcaactcttccaccctgaaacgttgattagcggaaaggaagacgccgccaacaactgtacgaactacttctggtcgggcctgaacatgtaagctaatgcttgtcagatgcccgtggacattacaccatcggtaaggagcttgtcgaagcagttgccgaccgcattcgtcgtgtctccggtaggttaaccacaatcctctgaaacctgactcttcgggaagtaagcttacacacacaagataactgcaactccctgcagggattcttggttttccactccttcggcggtggtaccggctccggatttggtgccttgctgctcgagcgtctttccaccgattatggaaagaagtcgaagctcgagtttgcggtgtacccttcccctcgtgtgtcgaccgccgtcgttgagccatacaacgctgttctctctacccacagcacgattgagaatgctgactgcaccttcttggtggacaatgaggcggtttacgacatctgtcgccgcaacttggacatcccacgtcccggctatgagcacctcaaccgcctgatcgcacaggtcgtcagctccatcacctccagtctcagattcgatggtgccctcaatgtcgacttgactgagttccagaccaacttggtaccattccctcgtattcactatccgttgatctcgtatgcacctgtggtctcgagcagccgcagctcccacgagagctttaaggtgcaggatctcaccttccagtgtatgtacttctctttgggccctttcgtctaggcatcggtggtggtagatggctaacggtggctgcaggtttcgagccgaacaatcagatggtggtctgtgatcctcgcaagggcaagtatatggcagtggctctgctgtaccgcggtgacgtggtaccccgtgactgcacccaggccatcgcctccctcaaggccaaggcctcgttcaatctcgttgaatggtgccccaccggcttcaagttgggtatcaattaccagaagcccgttcgggttcccgacactgagctggctccggtcgaccgctccgtcagcatgctctcaaacacgacctccattgctgaagcatggggccgtcttgaccacaaattcgacctcatgtactcgaagcgcgccttcgttcactggtacgtgggtgagggtatggaggaaggcgagttctccgaagctcgtgaggacctggctgcgctggagaaggactatgaagaagttgccaatgacagtctggagccggagggtgaggagggtgagtactgacacctttcactgccctaatggcttgtactgctttggtcacttcgtttcttggtctgtctcactttgccggtcaaattgtgtctgccccgtcctttatgcttgtgacaacccccttccttctgttcatgcgtccctagcgttgtttgatttcactgctcttacctaataatgaaccgatacatgcgctgcgggagaatatgaacacacgaattcatcggtcttttgaaaggacgtgagagtgtattccacgtggaaaaggaaaaagtctagtattctatcagataatatacacaatcaggtggttgcgagtgcgcgggatcctgtaagctcaatcctccttgctcgtagctacctccatatcctggagaagccgtaaagaagtctcataggtccacatcgtcaccgcactcgcgggagcagccttgaacaagctgaccgtcaagccccgataaagtccccggataccctgtgtccgtaggatcaatttcatcgtattaaacacaccctgatactcaggaatattgcgatgaatatataactgccgcgtcgggccctgcacctgcaacctcttccgaatcaaatccaacggaaacatcaccgtcttcgacgacacactcgcaatcacaccggccgccgcatcccccgatccaaacggcaaatcctgatactgcgccaacggcggcctcaacgcctcatacgtcgcgaagaacagtcccatatacgggacaatctgtcccaccgccgcactacacccccgaaaaaacccggcatacccttcattccgcgcaatatccctcaccgacgacatcagcgacgtgtacacccggtccgtgccctgcgcggcgaaccgcgtcctcagtagatccagtgggtatgtagatgccgttgcgagacctccggctgtggcgcccgcgacgaaggactctgcggatggtggaagacgataggtgtcgagttgtgctagcgcttgggttgttgttcggtatgcgctgaattggatcaccccgtagcagacgtacattagttcggcggggatgttgcctttccagaggcctgttataccctcttgacgaatgatgtctcgcattgtcgagagggtgcccttgtagatgggaccggttacatcgcggtgggagatggggtccgacagggaatgtatttgtagctgcaggcggattttgacgacgtcgaggggggcgacgcagaatctggatgagattgatggattaggtggttgtttggaggattgttttaggggatatgggagtgggcgcaccgtgatacgaggccggctattccgcctgctaggacgacttgtcgtcgtgtgccctggatagttgtagagttgattagcttgcgcatttggattgagaattgagagatggtgctaggggcctgagatgtgcatggctggattgttgaatggatggatggtccatggggatctgaggtggatgcgtacctcatccttgaggtgttctcccccggccgacatgcatgtgacggtggatggttaatgcgagagagatgtaggtatttgaagtaagattgatggtcgcaagtgatagcacgttatgtgaaagttgtcattgatgtggttttccctgtggtggtggtgtgttgtaagtggttgtttcgcttatggccttgtagaaaggcgacgggcaaagaaaaaaagggtaaaaatgatgttaacgctctagaggtatgacgtgtgtctgttgttggttcttttcttttttttcctgcggacggactttcggagacttcaaactgccggatttagttccgtggatactttgttgactttgctcacacttggatttatctactatgctactgctatttatgcgatgttaatttggcagcgggcaattatgttccgtctggaacaagcaacacaagggatggcaagaatatctcctggtggatgatgatgcctggtgtctctgcctgactgcctgactgcctggcctgtactttaaagcggcggcgagtcagtgcccaatcaggtgctatctgaaaaacctcggtacaaacaaagtcgcatcggatcataagttattatctgggggatctcctggcgtcccacttcttccccagctctccttcaccccccaaccctggagtccttggatgcgggcaccttcaggctcttcatagcaggtctcctcgctgctagtatccgccatgtctcgtctgttgcgaaccgccttccgccttccccgggcctcattccctccggcctccgttctcagccgtcgtgtctattcgtcctctgtcgttcgtcgctcagcagctaatgctatccctccctccaacaatgtggctcccacatcaagtgatgctgctcccacagctagcagtgttgcctccgcagccagcattgcggccgccgaaccgagtgcatcacatgaaatagcagatgcaagcaatgatcctgcatcatcgcagtccaatcaatcctcacctccggaagcaggtgatcaacacgacgataagacccagacaacgagcgccgggacagtggaatatcaggatgataaatacacaattagacgcaaagaaggaggcctagtcatcgaagaaggtcgcaaacgccccattgaaatcctagacatcatccttcgcgactcctgcaaatgctcttcctgcgtggaccctcactccaagcaacgcaatttccgcacgagcgacatatcctccgacatcatctccgagaaccctaccatcaagcacggaaagctgcacgtaacatggaagaacgacttccgcggcgctcccgccgaatccgcacacgagtccacatacgatctccgccagctccgacaccccatcatctcccccgtggaaatggagtccgcgggcaaaaaccgctggcgagcatattgggacaacagccgcatgcaacactggcagcactggatcacctacgaccagttcatcaacaacgacatctccttcgcgtggtccatgcgtaccctcgccgaactcggcctcatcttcatcaaagacatcccagactcgcgcgaaatggtcgagaagatcgccacccgcatgggtcccatccgcgataccttctacggccgcacctgggacgtgcgcagcatcccccaagccaccaacgtcgcctacacagaccagttcctcggcttccacatggacctgatgtacatgaacgacccacccggctaccagcttctgcactgtctccagaactcctgcgagggaggcgaatccctcttcgtcgacaccttccgcgtagcatacgacatgaaacaggacgaccacaaaaactactcccgtctccttcatcatcacatcccctaccactacaaccacccggaccacttctacacgaattcttggcctgtcttcgaaacagagacctttgataacagcgtcacggagggaactaatttctctaaatcccgtctcgttcacgtcaattattcgcctccgttccaggcacccaggaaggtgcagtctcctgtgccccgcaagttccgcgagaagaatgaggctctcgctaagttcgcttctctgctggaggacgaacgatatatgttcgagctgaagttgaaccctggtgaatgtgttgtcttcgagaatcgccgtgtggcgcacgcgcgtcgtgggttcaagactagtactggtgagaggtggttggctggtgcgtatgtggatgaggatgctatgttgtctgggtttaagacttcgtcgaataagtatccgaatttgtggaggctgaagcggaagggactgaatagtaaacatgtgaagatgttgaagggggtgaataagccggatgagctgccctagattttgacttatttagggtggggatagcgagagggaagcagatatccattgttaatgatacgaagagaggaagatgtatcatacacgttttgtacgtactgcatacagctgtgacctgagggtccgatacatgaatactatacatagtcatacgaagtggtgttgaatgagtcaatcaaataataaatggtcttttatttagtaggttttatagtaggttttatataaagggcgacgcaattcccatggcactcatgggtatagatatcatccagtcaagtactatgtaatcagcgaataaattatagacacaggaaagaaggagcaagacgccgctagatctcaagctctaaccattgagagttggaaagacaaacgtgaaaaatgaaaggtagagaaactgggtacccaatacggacaaagccgcggtattattcgacttaaaattctatagcctaggcagcgggcttgttaacggagaagcggtccaggaattcgggatcgttctcaagttcctccttgacctatttagaaacatcacgttagtactgcagacaaaccatgaaaggtaaagggacggaaggaggggccttacaatatccaatccaccaaccaactcaccctccacccacaactgcgggaaggtaggccaatccgcaaactccttcaagccctgtctcacatcctcatcggccaagatgttgaagaatccgtacttgacgctccgctcacgcagaatgcccacgatctgccgactgaatccacactgaggcgcactgggagatcccttcatgaacaacatcaccggcgcagccttcaccaactccgcgagacgcgcaaacagcgcctccttcgactgttcgggggtcaatgcgggggcagctgcgttgccgttcgtggcgggcgcctgtgtagcggtggcgggaacgttctctcgaggcacggctgtcaatggtggggggatcacggtcttgggagcaccgtctgcagaggcggcggcagcggcaccggcgtggcgctcaacggcatcgcgcacttggattgcttcactgccgctaatggtttcgagaatcttgttgtcccggacgaggactacgaagggaacagcggtgacattgtactcttccgagatatcagggagctcctcggcgttaacgctgaggaaggcgatggagggagggttggtcgcggggtactgggaggcgagggcggagatgacggcgcgcatttgggcgcaaggagcagcccagggggcgtggaagtagagaacctgtaggcatgacgggggaatggaggagatgatgttagggaattcggcctcagaggcgacttcaacgagggaggacatggtgatagttcggttgggttactgaggtggggtttcggcggggaaaacttggcgtctaatgtgacgatgggaggaagaagattatgagaaggatgagtggagttggtagggaaggcaggtaaagttgggagcggaggaggatcagggagggaagaagacaagaggcagaggggaaagagtcacaaagtgccccacggtgtggccgagatggagggaagatggagaggagcagaggaagatggctggccgatggcgaatttttggccgcttatcagatcgaaccatcggggccgtttgtaatacacggtccttacccgctttctgctctgcgatcttcggcgtaagacggagacgcggtggctccgatggtgtgtcagcaacaagatgctgccatgagtgctagcaatcactctgtggcgaatgcgcttgacgctataggcgctgtattccgctatctaacttcattaatctatgttgattgttcttgcagcatctgaacgcaggaacatgctgctccgttgataggcgggctagccctgcatgctatccgtactgtacggtaaccagatagattatcatcacgtgcctcaaaagtcggcgggattctgcgtcgcgcgacctctgtcgatcttctggtcgccaatttcccatccttgcctagacctgcctgtaactgtctgagttggcattgcgatatcggaagcacgctgagtgtttctggtcgattcttctgcagctagcaggccttccgagcccccgatcctgtcgtgatttgctctttgccgccccggtcgtcgccctaaacatcatgggaggaaacaagcgcaagcgcacagaggctggatgttcagatgacgaagatccagtaagaaacagctcagatgcgaatagctttggcgttgctcaaacgctttcgctcctaaactcgggcaagacaaagtctcagaacgatatcgactcggaagaacctgggaaggcgcaggatgatatgccgaaggaaagagcttcgaagaagaagcgcgtggatggggagaagacaaaataccccgtccttacctatgttgaaggaaaattgcaatcatccatccggatctccgatctccagagtctgctactctactgctttgctgatggcgtcgcgccgcagtggatctcaatcaaacactctggtcatgttaggaagattgtcgtgctgatggtgcctggtctggaactgggcatgttcgatggttcacttcctttggatgcagattctgttactgagaaggagacggaagaacctgccggtgcgggcaaggcaatggaggaggatacaaaagcggaagaatttgctcgctggaagcaaggcttgccgctggaggaccggtcacatcggttcaatcctcgccctctttcgcgtggtgaccttccggctcccctacaaccgctagcggacatgtttcctcacgcctggcccgtaaaagcccccggtgattccaagtacaacaagatccactctccacttcaagccatacttctatctgctctaccgaagggcaaggacagtaacacgaagggagtaaaacctcccaaggtggacaagagtatcgccttccagcgtacaccaatcaccacttttatcagttccctggaagatctccgggagaatgactatgtgcttcatccggctctgctcgccacagaacaagagaagtcgactttgttggaaaaccgtaagcgggccggacattccaaggaagatggatgggtagatactcacgtcgagagcttggaggctggtcaggtaccagactctgaaatccagcaaggcagcatgaccgcaggccgggatgtgctagcgttggattgcgagatgtgcataactgaaggtggccaatccgagctcacgcgcattagcatggtccgctgggatggtgaagtcgtactagatgagttggtgaaaccccagcgacctatcatcgactatttgactcgtttctccggtatcacgaaagaattactcgatcctgtcaccaccacccttgccgatgtccagcagaagcttctctccctccttactcctcgtaccattctcgtcggccactctctcaattccgattttaacgccctgaaactcactcacccgtttattgtcgacaccacatttatttacccccatccccgcgggccgccgctcaagtgcagtttgagatggctcacccagaagtatctcggaaaagagatccagaagggccagaccggccatgactcgatcgaagatgcgcgcgcagtgctcgaacttgtgaagcagaagtgcgaaaagggtgagcgctggggcaccagtgaggcatcgaacgagagtattttcaagcgcctcgcacgctccatgcgttcggggaaatcggccaccaacgaaggccgcaccggcgctgttgtcgactggggcaaccccgagcgcggctttgggtcgcaggcgactgcgtcgatcgggtgcagcaacgacaccgatgtagtaaatggcatctcgaaggtagtcaacggcgacgacagcaacccctccattcccggaggtggtgttgacttcacatgggctaggttgcgtgagcttgaagtttatcgcggctggtgcaatcggatgcccgaccccaacaacgccaacgagtcgacgacgctcgttccccctcctgaagaaacgactccgacatccgccgccgtctcccccaccaaagaagccactcgcaacctcgccgacaccgtctctcgtaccgtctccaacatccaccaaatctaccaatccctcccaccttgcacgttattccttgtctactctggtaccggagatccccgcgaagtcagccgcctccaagccatgcacaagaccttccgcgaagaatttaactcccgcaaaccgtgggatgagctgaccgtcaaatggaccgatactgaggagcaggcgctcaagaaggcctgtgagcgagccagagaaggctgcgggttcatgtgtgtgaagtaataaacatcttacctttttttcttcttattacgtcaattattttttgctcttccgtacgggactgtgtttttgaccaggcagcagaccgggttcaggatacaggtcctggtggtttggttcgcttattgggaatgcctttcgaggcttcttgcggaggttccccatgctttgaactctagattatgggtatgcgagccgcgcttccgaccaaaaactactcgcctactacctaactgcctagtatctacattctatcacgaacaaaaaggcacaggacatactgaagcgatctcaaaatcggacatttttgaattggttggttaaaattgggctgaaccacatccagtgtggggatatcattgtgcggaaagctagactggcaatctcagcccagtggggaaatgtatcaaaggggggcgccatgaaagagctagtaaatagtaaggctgcgggtgatccctatagagacctgtgtagggaaaaaagaaaagaaagggggccactttttgtacaaacacatgaaagaagaaaagagaagggacgtcacatcacccaaggatagaatatagataatacatttgatagaaagaaggatgaaaggaataataaagtgagcggatcagtctagcttgcttgcttttgtgtatcaaaacagaagactatacgttcttgttttaaaaatcccactcaactcgctctcaccgcgaatcctcagtctccattgcttcctcgcgctgcatagctaatcgtaccatgatatctcgcgctgcggactgtgctttgcgtttctctcgtatatcgggcttgtgcactccgtttgcgccgccatgcgagttttctttgcccgtgtgtagtgggggcgttggctgttgctgttgttgtcgctgttcagtctggtctggtacgtcgtccccgttctgaaacccattctgtgtttgctctggctccgaaggacgtgtgtcggcattagctgcggcggattggcgccgtgacgggggccgagacctactgcgcaggcttcgcgagtgagcgggtcggttctcttttgtagtgcgggtatcgctgggactggaatcggtgaattgggtgtctttgtgcgtgttgccgttttgctcggtcagtgcgatggggtttgggctttcattgttcgcgatgttggtgggaatgtctggtttagcggtttggctgaatgatttgcgcgagggtcggccgggtctgcgtccagtggttgggggtttatctgttgattgagataggcggggacgttttactatggcttctcggtgggaggtggcggagttgttactgttgtcgtggtgatggttgtcgtcaaggtcgtttccgtggttgggggtttgttgctgctgctgttgttgtcgttgcgaggggttgacttcgatgtggagtttgggggagcctgatggtgtaggctcttgggttgttttgtctgttgtggacatggatgtggagtccttcagtggaattttgactggaggtaggctggcatcttctagcgagaagtctgcgatgctgtctgaagagtcgtcgtcgaacgaatctcttattgggtgggtgcgtccgctcggaaatgaatctggccagggccgcttccgactcccctgtaataggcctggacttcggacttctgcaaggactgttgtgtcggcgtataacggtggcggtggcggcggttgtacttgttttaaggtttgttcttccgcgtagcgattcttcaacttgagtgcttcgttttcgagcttcagtcgttcgatctcatcggctttggatctgagttccttcaacactgttgcaatcatcatgtccttgctggcgggggtgcccatatcagatgtgaatcgacctgggccgttcaattcgatgcgcagcgcggtgaatgcgttcttcaactcggacatggtatcgtgaaggttgctgacagaacttgtgatgtgatcgaggctcagcccttggtgctggatctgttgttccatagacatgttgtaggggtctagctccgtcgatgtagtgggtaccagggccccggcatggactggggttcggtcttgtcgggagggaggagtcggacagaggatgcgttcgagcgatccatccttgaatacgggctctactgtgcgcatggtaacaatttcccggaacgacaccttcgatagcttccagaagatattggggctgcttccgtgttagtcgagaaacgtgagacagatgccttccagaataatccccccacttacccattgtctagagagcagagcacgcccaacttctgttgacagagcttacaggagatttcctggaggatccggcctcgtagggtactcagctctgatgattgcgggatctgcttcttctctgaggagatggaaatgcgatgcagctcaacgctcagccatccagccactatggagtaagaattcgaaagtttagcccactcgttctccagcgcagccagcgaactcgagcatcgcgagcactggcagaggattgcggggcgggtaagccgagacagatccatggcggtggacatgacggggaggcgcgttggaactcaggccttgaaagagcgtctggccgtgagcccgcgtgaagttgcgagatggaccaaagtcagggcgcaaacctgcccgcaaaagtccagagggatctcgactgctgactcagccgtcaatggagacacgttggcgggtcgaccattcccgattaggctatcgataagggccgcacgcgtttcactgtcgtcatacccggccctccgtgtttcccgttcagtggctgggcccggcttccgttcccctccgtgtatgtatctttacgtatgttaccgtgatgcttctcctgatcagcccaactagatatagcctcagctacttacttcaatacctatacacttggcattgctgtcaagaatgcagtccattgagaatgatagaatctctaaaaaaaaaaaaaaaaaaaaaaagatctcgatcgtgcaataattgtgtcacaatgcatggccttctgctttttaatacttggtgtatggaggagagcactggcctttatcttccgtcacagccagatatgcaggtaagacttttgacagtcctcccaattaaattccgtactaaaaagtctgtttagttttagtgttgaactaactactacctagatgcaggcttccagatatctacaaaccagcacacatgtcaatctcttgtttctgttcctctcctgctcattagttatccttgaccatgccttggtcagatcacaagtctgctcggatatcccccatcggagaagtttaatatccagaagagtatgaactataattgtcttcatctgcagaaaacaagccagtagccttgacatgcggcttttttggctagcattgtctgggttcatatgattcttctcaatgagcgcgtagttattcatcgcacctcggcttaaatgggagggaaccaggtctcactatcattctttgcctgtattgaaaatgttgaaagtgggacatggcttcgtggagctttgttttagaaaactataaaaggttaagtggaactgtaaggtttacttggtgaagtaggtgtcgaaggtgttaagattagcggtcgatgtaagctgctgaatctgctaggtttcatctaagttcatagtcccaaacgcatcctttaagctgtggtggtgctcaagactagataagtcaatactagagaagaacgcttctacttcaaaaattgatcatgagaggaactaggccgaatcgagtatgaaccatgcaccgccggggtccatctcattgtcgaatcacagccctccggagaatctcctcattgttcctatcggtgattagtcactttttgcttcccctcggaatgtcccccgcatgcccgtaagattaatagttaattcgttgccgctgcctacttgcttttgccttagccctgttatcatttcagttttgaggctcgatgggatccttggcccgctattctcttcgatccttgtttcctttaagaccctccttcccagtcccaagatccgcataccgttccaggatcgccatggctagcgtatcaacagcttccaatgggagcagacccagcacgtggcagggcgctggggcagctgagtttgacctgagaagtgagtatgactcatagcagaagaatgctgccatcgtgacgtccgcttttgctgagaatcatgtgtcgtaaggtgatacaatgaccaagccaactccggcaatgctcgaggctatctgccagaccacacttcttgacgatgtcttcggtgaagacccagtgacaaatgatcttgaagcttatgtggcagagcgtactcaacatgaaagcgctctcttggtcatgtctggcacaatgggcaaccaggttgccatccgcacgcacctgaaggaaccgccttattctgtcttgtgcgatcatcggtctcatatcatctgttacgaggctggtggagtaagctccctcacgggcgctacggtcatgcccgtcaccccgaagaatggtgttcaccttactttggaggatataaagaaacatgcggtactcagcgataacatccactactgtcctacgaagctcatcagtcttgagaacacgttggatgggatggttatgccactttctgaggctcggcgtatcactgaatgggcccatcaaaacaacatcaaggtccatctggatggtgcgagactttgggaagcagtggtgtccggtgccggtagtttgcctgactacactactttgttcgatagcgtaagcctatgtttctcgaagggcttaggtgcccccattggaagtattattgttggctcgaacgagttcatcaagaaagctcgatggtttcgcaaatccatcggtggtggtgtacgtcaagctggagtcatctctgcggcggcccgcgtcgcggttgaggagacatttggaccagaccccaatggacagcaagggaagcttctagggtctcatcagagagcaaagaaggttgccgatatgtggactagccgtggaggcaagctatctcacccggtacagaccaacatggtgtggttggacgtcgaggggtcgggcttggggcctgatgacctggctgagatcggacgtgaaaaggggttgaagcttgggggtagtcgcattgtcgtccactaccgtaagtatccctttcccatgcgaactactctctcctaatcaatctaacatgactgcagaggtatccgaagagtccctctctcgactcgagcaggtgtttgaggcagctatgaacaagaaagcttgagcgtagtactgactaaagtaatcatacggtagtcgctgaataatagctctagtggatataggatagacccgacctgaatcactaggaagtaaatcgatctgaagtcgagtgtcacgcgttggatccacggattcattagatgcggtgtgttccgcccgcctatgcgcaaggcgcactcttattggctcaggtgtggccgtccggggttctgccttgttggtgcctggggctctgctggactttcaaattaaagagctgcggtttaccaccccagccttgctgctgcatgtttctcggacgacgactcctgtcggacagtctctcgtctcgtctccgtccctggctccacctttcatgctccctctatcgcatctccagagcctggcaatgcagtagatagttggtggagactttgctagctgtgtgagtctaactttccgttctctgtgcactgttgtttgttacatgggcatccttgactgatacctgaacttgctatagaaatacgcttggtgtccctcacaaagccccttcgacaaattcccctttcgctccttgcttcaatggtccaacactacgaattcctgagcagtttaggtcccaatctggttggctttcaagcctggggctatccatcacgactgagatacttttaagacctcgctgcctatcgctggaaggcacactgtataaagttttgtttggtacatttactggccctcgttcctgccagattattatcgcatacaccaggccttggataatttgggtgtgatatcggggtgcgctctcttaaggttgctggaacatcgcgcgggctggtgctgtcgtttggttgctcgccaggtaaggtctttcataccttcctgcatcgctgcaagaattgttcagacatacaaacgaacaatcttaaaatcctagcaaggcttatacttccaataggtctatgatatggagtcctgttgatcatcgccttggttacgcatagtcctattcccatttctctactcgcaacccctgcacatatacccttcagtgtttgtcttgtcaaatagtttgctcctactttttttgcattttttttttttctttctttacaatattctttcatttcccggcagtcgcactggttttgtcagccctcgacgtcatcatcaatatccgtgcagatggaggcgacccaggagtccacccagccatgcacggaccctcgccgcatgggctacaacaattcggccctccacgaggatgatctgacggacattgtttgtatcttacacccaaattcacctgcagcccatgatgctgtagccgcaactgcgcgccacgccccgcagcacatcctacaaagggatgcgctagaatatgaatgttcagataccgcagctttggacttcgctcttagactgtcatcagatgtgcatgacgcaaacacgggcttttgcttcggacggaacagggctcgctgcgatcttctcattgctgatgctaattcgaaacgtatttcgaacacgcacttccgcatctatctcacgcaagatgggatcataatgctggaggacacctccaccaatggaacgattgtagacaactgccgtcttcgcaagattcaacgtgagaagagccgcatgctagtcaatggttccgtcattcaggtgccgaatggtgagggccagtcttcggaggaagtcagatttatcgtgcgcctgccatcccgggaaggctttgtcatgcagtacaccgaaaatatgcttcgctacttcgaaaagattgagacgcaaagagcaggtgcggcgcagcccagagctcgtacaacccccgcgcccgctctgcagatcgcttcaccaaatacgtacggcatgcactggtctggcggagcaatctacaacgtgacggggcaaataggcaagggagcctttgcaacggtctacaaactcgctacaaagcagcatggttctgtgtatgcagctaaagaactcgacaagcgccgctggatgaaaaatggcatactcgacaagaaggttgacaatgaaatgaagattatgaaagatctgaaacacgtgagtaatcacatcaaataaagttgtggactttcctgttaacattaatacctttcagcccaatatcgtccaatacgtcgaccatcacgaacacgacagatggatatacatcatcatggagtacgttcccggtggagagctgtccacatacttgcagtcgcatggcaggatcgcagagccccaggttaggactatggcgcgacaaatcttgcatgcactccactatctacataaacggaagatcacgcatcgggatatcaagccagacaatatcttgatctcgtctcttgatcccctacgggtgaaattgtcggactttggtctttcaaaagtagtccaggaagagacttttctgaggacgttctgtggaactttgctgtactgcgccccggaagtctatcccgagtatgacacttaccggcgtggtgaggttcggaaacggcgcaggctgggtgatccgtgagttcctaataccatatgctctgccgaaactgtactgaccattagacctccaaaaacgtccccttacgatcaatccgttgacatgtggtcgcttggagccgttctatttcaccttctttcgggagtccctcctttcgctcctcgaggagatgatcgtggtgctcagatgctgcgaatcatcatgactgaggatgccgattatagtgaacttcgcaaggcaggcgtctctgaggatgggatagacttggtcgctcgactcctgaatcgtgacccccagtctcgcccgaacgaacgagaatgttttaggcacccgtggattgcaggagttgcggacattgacgaatatgatgacgaggacttgtttttgggtgtcccagatgagctttctgatataggcgaggatgtcgaggacgaaatagacgcctcccaactgtctttgaatgataagccggcagcagaagtcgcggctgaggaggaggacgaactggcccaggccaagaaaatcaagcttgaatatcctccggaggaaattcgttatccgtcgctccccagtctcgacagtttccaggctgttcaaccaatttcccagtcaactcctaaacgactttttggtgagattacgccatcgatactacgaagttctcacgcgttgggcgacaaaattgatgcatttgagggggacgactttggcctccatgacttcgtttcttccactggtgagtcgattatcagcgacggcaacagcctgaactccatcctctccctgccggaaaaccccgtcgccgggtctgcacctagcttaatgggagctgagaaccttgttgggcagctgaacatgaactcgtcgcaccctggcttgaacaacattccccgtcacgtcgaggcgccggggccgcaaactagcatggccgcggaagtcccgaaggacaaggccccagaagtacccccgcagaccactatcgatgatgaaacccccaaggcttcaaaatttagccggcggattgagctccctatacctgatactgccagtgagcgttcgagtcctgaagcgacaacggggaagaccaacgacaggtgtgctgagcccgaagctgcccctgaagaggtcttcgacattgagttggcgaatactatcgatgccaaaaccggactgcgacttcctgacttgccgaaaagggaagacaatcagccttccccacagcctgcatccgaccagacaccaagcccaatcctcaatatcgcggcgcagcctagcaaaacatgccccctccttggaaagctgaccactctcccagggtccatctttgagctcacaattccgttggaagctcggatgacatcctggggccgcggcccccaagcaaccatatgctatcccgagccgatggatacgcggatacctgcgtatgcattggaggttaccttctgggctccagccatcgaaaccaaaattgccgctggacacgattggatgactgtccccggcgtgatggctattctctcaaccaaaacccgaaaatgtatctgggtcaatggaactgagctgcgacgcgggcccgagaacgacaatggtggggagggcttccatttcggtaaactgtataccggcgatgtcattaccgtctatcagcatcggaacaagtttttaaagttcgcgtgcgaattctaccatggagacagtgcgcgctcgcgtcccgatgaggagaaaggcttcaccgtgcgcaaagtcctgatgcccaaggagaaggctgccaaccgacaacctatgcggaaaacaccgcatgggaagaagtaggcgtcgatatggtggcagtcggttcgctgactcagttgaaagtggctatgaggtatggtgtaaggtccctggtgtggaatggagttgtatgtatctcttatgtatgggttgcatcttcgtttggtcttgggggtacaaatggggtggctcagtaatgattttggcgttggttgcatatacctaatgatctggataaggtaggggcaagaggaggacaaaaaaaggaaaaaaggctactctcgtcaatgcatgtacgatcatcaattgcatggatatttatcaatgaataccaacaacaattttctactcgttcacctagcatacgtctgagacaaaccattagaatatatagaatatatgaagtgacaaattgccattgtccatcccagtcccgtctgataccttggtttaatagtatcgccttgtgcagaggactacttggagtaaataacgagctgttgctacgtggctggtattagatagcacccccgtcatgagttgttcacgcctcagggtacatactaagaatctgattattgggtatttcgacgatcttagagctctgattaaaaagagaaattatttgtatctgagacatgactttgttgtctacattcaaactcagtcaggctagaatattctctattctagttaatctgctctctatccctaaggagacacaatagcgaaatacaatctacccttgcgactcatccttctgtccttaagcataggccactgcgtatcatggtcatggacaaccgccaggaatagcaatcccaggggggtcgcacgagttatgtttgccctcgaagtaacagccacctgacatagaatggagatcagttaagccgagtttcccagaggtggtagagtaaagatccagagatgtgaaaagacacaccatttccttgacaataacagtagttgccaatgtcattatcaggatctgctctataagaaacttagcattaacttcgaaataaataagatgtctgaaatgaagacagaagggcacctactggttataacaaggtccaatacccttagccacggcaactcccatgaatagaagggcaacgatggcgttcatccagagtctcattttgcacttgatttctacggattcgtatgtaagggattgttttgcacgagaatattttggaagtgaaatgccctcgtcagatgcactgatagcccagatttatatgaaaaccgccattcaggaatgttgtttgggtcggagtttactaaggactgccagtacttaggcaatactaatggtcacagtctatcgacttctttctgcattacagacgaggcgattaacgaatatgcctcacctcggtagataccatggcctgatatcaggactccgtcgctgacatcggataacgcggtaactgagtcaccagttgatatccttgttgaacaccagcctgaatctattcaatgcaacgctgactgcagtaacacgtattgagcttatgcctagtgcttacacgcaggtattgtgccaggggccctatgaccccactggccatcttgggtgggtcaatacttgccctgtggtgaccggatctaccgctaacctgacgaagaagtcattgcgagtggttgccgcgagatgcgaaaagtgagcaagataaccagacagttcaattcttgacgaagaatagttaatagttcaatgtgtagaggtcaagtctacttgttgcgtatgggttggggctaattagagcggacgattcgaggcaataactatgtatgaacgaaggcctcaagtgacgatgtatatctgttcttcctatccattgaagtggcgcctgatactgttccaatcgtaaggcagtgattagactggagcatatgactctgagtgatataccgtatactagccccgccttttgtcttcctgtcaggcgttcccgaccccggttgctctcaagagtatcattctgctttgaatatctgtctgagtgggacaatcgttcatgatgcatagtttcttagcaactagttctttacatgttaatgaggcaattatatgataggtctacacttgatagacgatcctcgtcatttctataagccgaccatcagtttgtggttccaccgcctgtttgtttgccttagcacgttagctcacccatctctaacagagtggatacccagtactttggtagatgttgatgtgggtttggaatgtaatgatcccgtgatggaaattgagtttgctctcattagtgcacacacatgaataatgcttgcaactactcgctccgcaccggcattaccgtttgttcctagattcgggccgggaatagtcacctactgtgggacttgacacagaacatgggatatagttaaggagaatcaatacatggtattacatagatataacttttgcgaaagccaagtggtcatgctccgtaaggtacaaatactaccagtaaattactgtaagcgttgtgctactagttagtgcaagggtatttcagcggatacataaagccaacgctaccacctccgttctcatattacatcgtctcttgtgtgccactgatcttcattcattatttcgccagcctgtccaactcggaacttggttcagcccaatccctacatattataaagcggccaaaatatgtcagttggcgcagatcaggaaactcccctgtctggtactgcaagccaaactccctcctttgctctcaacgcgacatcggatacagatgagtctcacgccgtcgacccctcaagcctgactacctacgagaagagactttacgacttcttatgctctcaagaatggactgatacacagtgttcttgtttcatcgctcatatcgagcagatgaaagaagccctctcgcaccatttctactcgcaaggttggaataccgttcaagtgcagcgtctccacgaggaatgtgagatggaatttccagagcatttcccagctcctagaggtgatgccgagcaacaagatctgcagatgcagctgagattcgtcgaagaaatgaatcgtcgaagggcgattggcgagcgcatgtgcccttcaataggcactatggacgggggagattgatgagagaaggacttgagtggaatccgcttagagctttgggatccgtatgtccatctatctttgctcagtccgcgtgtatgtggttcttttgctgacttcgtcgagtcagaaatgcagagtaattgaggcgcgatatgccaattacatcaatattcaaggcttaccacaaagcttgatgcttagaatcaccttccgcatcagatcagttctcattattcttccattcttatttagacatgtagcccgtaatttttcaatcgttccataccgctaaggtccggaatactggtgtcctagcgctctaattcgttacggtgagtttctagtgcgagagttgccataagtgcggcttctctaactgctactatgatctatctagaagcttcaggggaccgctctgtcaatttgccgcttctgtggtgcgggtaccacatctaaacagtgcaaaggcatctgtttcagcccgtatatctttagacagctggcgttggatttctcgcattggctgctcccggtcgtacttcgtttggatctgagaaaggggcttttctggtactcgttgtcaggcacctgctatctcttagtttaggttcttgtatagagtatatcttttcgttcctctatcccgagtccaacacctcttcgccatcaaccctgtctaatgcgcggtctgcgaaaagaaggctcagaagatatacatgcaagctaagaacaagaaaaaggtcgaaaataaattcggggagtatatgtatatttctgagatactggtcagaccgagcatgctacgcggtcgataatttgggttagtattttcaagacccagccactaagtaacttaagtaagtccttcgtgaattcaaagatgaatcaaataatcatgcaacgtggctcaccctgaggatcgcagagtaagctattctaaagatgtcaatatctaagatctaagatggtcaaattacgatttgtagtgagaccggcaagctgcaagaatagtctcattcccatacaatggcgactgtgcccgaatttcttcttagtagcagtgatagtggtctctataaccttcgctcaggaggcttaacccgtctttgggagaaaacttgtgcttcttggctaactctcggatcactacacaggtggcatggattgactatatagttgattacgcacgatatcatagtggctaccggcgtaaagccatgcggcaatggaaggatcacacatacttcatgtattgagtggtttattcatgtcccaatctcactagaagtttgactattgtagactagtctgaatactctcatagaaagaattcaccggaaagagtgaaccattcttgaagtgtaccttattggaactactttttgcttgacccggtcaaggagagcggtggtacttctggggcagccttcttagatatttaatgtctcgtcgatgtttgctagttgctggatatagtactccagtggatgttcgttgtctttgaagagcaagtccgcgtcactggcatcctgtatttggacatcttcatcctcggagtctgtaatattagtatcgtgtcatttattctcagtactttgtctatcagaacaattactgttcttggataactggtagtctgcatctaaagaacagtaagccataagatgagattacgtcaaaataaagaacaaaaaactgttgatactccgaactgaaggattacttattatcctaacgggtctgagcatagatggaatgtctctatccaaagtctaattgttgtttgcagagtacagctattatggcacgaaagagaaatcgagcttctgcatagagagcattaatttataatgagaccttgggaaaaaagcatttcagcacccttgtcaagcagcagtgcggtggacaatatgctctagcaaagtatagctgaaggttagaaatcgtgactgacagccgagttgctgtcagatgagcggagcccactacacatgatactggtgcatgggtgcatggacaagagtctgcgtcagtggttagaatactggcaaattgacagccaaaaacagcgtcactcccggccattgaagttctcaatatacatataacgatatacagtaatttctatgatatgtaggagctacttgcgaagagagactagcagcgaccctcatagggtctggacttgactgggtccgtgaagcctttacctcttggcgacaatacgaaggccagttccctggttcgcaaggtggtacctattcaccttgaataagcgacgccggaagcagacagatccaaggaacacatcaagttatttggatactgtcaatgatcacgaatcatgagctcgtgaggtttcccaatgcgtcgaaaagccacgatggaagcagggcaacaccaccaccacctcaccacatgtgaccctgaccgctaaagtgaaagacggagtgggtctcactctctttccatgtggatcttggagattagtttctttctgctagtcaagtcggtctttctcttgtctctcgggtttctagcagttcttccatcttctccgaactggaacatagctcgaatgtgtcccaccgcactgcttctttgtcgcattgggggggtctgacagatgtgagacaaccgtctcgagccagcgtgtccaactcactactacttgcttgcaaagtaaccttcgaaatgagcagctcctcttcccaacaaattgccaggctccaaccgttcgtttcggcgtctgcgcgagaagctcaagcgaggggcggggctgtttctaggatttaattaaattaatctgctttttgcagtttaatctccttcttccccaccaccaacgaatgatgctctgtcggagcacctcatcctcactcactctctctctctctctcacacaaggtgacagacgatgtccgactcattgggtggtcatcctgatagccatggcttggattctttccatggtcctcgcgcggaatgtcttacttgacgataaggggagggagaggagaggaggtagtagcgccctcatcgctgcctcatgggtgttgttgacccttggatccattccttccattcttcaccagttctccggggccccctagcgcgcccttggaactgtaccgttaacctgacaagtggccctcaaaggaagggaaaaaaaagctcccaaacgaaagcggacagacccgttcgcggatgggttttctgttcctggattattgtttcggcctttttggcgacttggtgatccagtttttatcaacgaccatgtcatgctattcctcttccgtcgtttcgagctggtgactcctgaaccgaagagtaattttactttaatttctagctctcttttaattttctgggtcgatagcgatctgttacttcactaacgtatctcctacacctccgctccaaaacctcgtcctttttttccatcctgctgcgctcctgttccccaagttgcgggcgcccgtttcaaagaaagacatctcccattgacctcctccacagcggccctctgccgagcacgaactccccaatcacgcccgcctgtggctgctccgcgggccgttgtgctcgcccgccattgcccttcctgccggcatccctgtcggttccgactccccgctcatgtccttgtcgcgatcgccctctccccaccccgcgggagcaggatggtctagtcctggactcacttcgcccagtggctctaccacgcctcacaatggcttcctgtcgccaaatcccataggcgccagcggcatctcctgggccgccgccaaagcgaagagcgacgaggtacgaggctacccgtccttttcgacgaagaacagcggattcttctcgcgctcaagacgccagctctccgccactttgccgcgctttcgtctgggctcggggtctccgaatggttatgtcgataaggatgagtttggccgggggcggcctctctccccagctacgggctggcgcttggggtttggcaggtcggttctgcggcgcagacgatcgcgcttgctcgtggcgctgatctttcttttgctgggctatatgttttttggggcgtgtaagtgaatcgcataccaatgggaagaaagcctgcaggtagctgaccttgttacagctcttctccagaagtatcggcgctctccgctaggcggtgggcgcaaattcgtgatcatactggaatctaacatagaaggcggcgtgatggagtggaagggagcgcgcgaatgggcgatcgagcgcaacagcatatggaacaagaagaattatgtggaacgatggggctacgagttggaaaccgtcaacatgttggcgaagaagcggtattcacacgaatggcgcgagagctgggagaaggtggaccttatccgggagacgatgcgaaagcatcccgatgctgaatggtatgcttgccgtatttgattccgtgagcgtcactgacatcttgtgcaggttttggtggctggaccttagcacttggatcatggaatactcctactcgttacaggaccatatattcgaccgcttggatgaaatcatttaccgggacatcaatgtctataacccattgaacatcagccacccgccggacgacgcttatctggacgaggtgtctcgttcgccaaacggagacggggacccatcatcggtacatatgctattgtcgcaggactgtgggggcttcaacctcggctctttcttcatccggcgctccctctgggccgaccgcctgctggacgcgtggtgggacccagtcatgtacgaacagaaacatatggagtgggagcataaagagcaggatgcgatggaatacctctatgcgacgcagccgtgggttcgcagccacgttggcttcctccctcaacgctatatcaactcgtatccccagggggcatgtggggacgagaatgacccgaatgtccactaccaggaagatgaaagagacttcctggtcaacatggctgggtgtcagtatggacgcgactgctggggcgagatgtaccagtaccgtgaaatcagcaagcagctgaacctgacatggtgggagcggatgaaggacaagttgaacggcctttacgagaagcttttcccgggcgaggaacagcaagttgaatgaataagtccgttgctgggatacggcatgttgcttcactttgatgtttactgcagatgatgattggtctgagacatgaccatgtaaaatgcggactaataacgacctggttgacggcgtatgggatggattctacgtttttggctgatttgctatttttggcgaggcgtttggtgttagcggtagctatctagacttcaagtagctcatctactacctctttatctgtgctctgcaataatcaaaagacttacgaactaagtattatacaattgtagttgcacaactaaccactcataacccgcttagtaattatccacagccccacgtgacacaatgaacttagcacacccgaccgcccacaccccccaaccaatcaaaccaccgcaattgcatctgctactctcgcgacctccggaattgaacttgatacactgactgacctctctacgtacgtactctccctccggtccctcctccaacctacacaccgaacctcctccccccgaaggcaacaaccaagggaacaccgaaaatgccgacccccgaatccgcctccttcctggccaagaagcccaccgtgccgccgacctacgacggcgtcgacttcgaagacaacgtcgctgtccacaacgcccgcgacgccattatccgtgaacaatgggtccgcagtatgatgtctcgactggtcggggaggaattgggaaagtgttatgcgcgtgagggcgttaatcatttggagaagtgtggggttttgaggggtgagtttatacctgttctttctttctttctatcccgggagcccttttggggatggtgtgggctagcgaagatagagtgagaattatggctaatatgtgtctctcttttcggtgtgtagagaagtacttcgagttgctgggcgagcgcaagatcaagggttacttgttccaggagaagaactactttgctggggagggaaacaagtctgcttagattttgctcggtggattgaattgaaattgggtttgcagggtttctgtgttatgttatgtgatatacaatatatgcattgtggtttcttttcctacttctttttctttttcttctgggtttggtttgtggggagttagagggtgtgggtgctggttttaaccagtccgggctgtgagtgtatgatatgctttgagctgggctggatttggctctgccgtggtttatatactgggttgtgaggtgcgagtgaggggtcgagtgtctgtattgatactgcgtatgtggagtaagcattatgggatggtaatatgcttgtgctcagtgatacatgtataggaagaagctcgaagctcgaagctcgaagctcgaagctgagatcaataataggcactgtcgctccgctccggtactgtccccggcgtatacacacgcgccacactggctgcctcctcgtcactgtcctcgacatcacttcccggtccaaagtcgtcctccaccggcggcgcacgcatgcgcaccagctgctcctcatccagcgagggaatcttgtatggtgctggcgccgaatggatatctcgaccggagggcaagttggcaagcaggtccgtagagggtgggatcagctgggtattgatctgtgttcgtcagcaacatcatcctaaaccaatgacgtgaacatcaccaaccgtatcattcatccgcacccacttcgtctccaacatctcaatcactcgactctcctcctcccgacctgcattatcccccggtcctagctcgcccttctccgtccgatcccgactgcccgcatctttctccattcgtctctcctcccgccgctccatccaaccctgcttcaatctcgacagtccggtccgactcttagtattcgtctcctttgtttccgctgcagctgttccagctccccggacccccaatgcccccttcgctgctctcagccatgcaatgccctccccgatcttcccagacaattccgcatccaccccgaagaaccggcaggctctcgcccgcgcaacccgtcccagtacccgcgtataccctagcagatcatcatcaattcccatccgcccctctgagcggacagatcccagccccgcagcagcttgttccgcatactccgcagcccggatacataatctagcgaagaggtgcgcccggaccttggggatctccggcgcgcggaccatccagtccttgtcattgggattgcgcgcttgaatacaggccgcgacgtaggaatcgtccttcaagacagcgaggagagttgcttctgcgagggcgagacaggacagggccgcttgcgtggcggggtcgaggtccgggagggtagatgttccatttttgttattgcagatggaatgggctgcagttgcgaaagacggcgaggaagcgaggagcgagtgtacggcgctggcttggaggaggtgtttggtggctgtttggatggcggcggtgcgctgttccggagtcggggtcgcggatgcgtaaagtgtgcgggtgacgccaatgcgggcgagcgagttgagcacgtagctgagggtggagaggacaaaggctatctcgaagtcgaggccctgtccctggatgcgggtggtggtgggccgctgtttgagggagagcgtggtggtggggttggtgagggtcgggcgccaggcggatatgatctcggtgcggagggtgatttcaatttcttcggtgggtgatgtgtcgccgggcttactgctgaggccgttggaaagagcgaggaggtaagggaggtagctggttatggtggtgaggagagtctgcaggtgggcgtcttgttgcggaccgcggggtaaacgcttgtgtgctttgagagcttgtcggagggcatggcgggcggtggtggcggcttggggaagagaggggtgggtgctggaggtaaggaaggtctggaacgaaagatgagaggtggagggcagtgtgaaggcgtagaccatggtgatggtggtggtgattggggtgttgaagctggagtggagtaagaagaggagagctggaggcgagttggaggtgaagatctccgcggcagccaagaagctcgtctgcattggaacctacgggaaaagcacgtcgggttcaactcgggcctactggccgattagactaattcatgtggctttatacgctgatatgctgtagatacatgatttcgtttgcaggatggtatttccatccctcaaaattcgtcccgatggccttcttcgcacatgtctgaaggcgtagatgctgttttctgactcggtggataatggtaaatccagcctgctctgtccctgaactgtgacaacctgtctgtagcaatagcaattgatatgctgataatcccaagctggtggacgatctgccgggtcgttgtggtcaagctgggccggccagctgtcccaatgccagatacggtgtaggcgttgttgatgcagctatggcgtctatgagtctggcttgtcgggctgcagacgaccgacagccttatcgcagttaatcgtgaagtgaggtctcgctctcaaacggcctctgtttgctgtctcatcacacatccatcccttcaccatcggacaggttgctcggcgcactactgacaccagacgaatcgctgtcagccatgtacggcgcccgcgaccgcatttgtgaaccccagtcctggagactgggcgcgccgccctcgatgataataggatgctcgtcggcattctttcctagcacagttcccgcatatctcgactcttcgccggttttgctgtgtttcttcttcaatgccgtcaaaaagtcttctttctcgagagcgtccgcatcgaccatgtcgccttcgctgggcacaaatccagcaatccgtcgaatctcccggttggccggcccggtgaaccatgacagaaagccctccaatcctcgcatatcctcttctccctgccagtcctcctcccactctcgaagctggggtcgtagcgcgcctgcatcttgcaaggcttggtagatatcttctaagaccggaacagggtcatgtggatgagcgttggcagcatgggtagtcgcagatgaagcaaggatcatgatgtattgggcggtaaggtcagcgagggtgtctaaaacggatggtcgcgttgcatgaaagcctgctgcgcgcaggatctggataattggcgggcggagaagagcgttgtgtagattggagccagacatgttggcgtgtgggtggtagacgaaaagcagcgatagagacgtcaaggagagcctttcagctcgcagaccaggattatatagctaagaataataagcggctcactgcgtcgctattgttgaggtcgagtgttaggagatgaataggaagcaaagagaggatcaatggctgaatggatgggcctcttactgcctctttgggtcttccgccttcctggctccgccctcgagtcttcgtctccgctgtaacacagcaagcttcactttcaccccatccgtttgccagcctcctaccatctctgttattggtcttatttcgctcacttctatatcgcatctccaccgacttggtggtcacctctcgccatgtcggacacaccccgtccatcgctcaagctcaccttcgggaaaaagaaggcgcccgaggaaccatctcagagacagcctgctgcacctcctccgccaacagagaccccccaacgcaagctcacgctcaagatcgcccgtaggccggcaccagaagcgcctcctgaggatgacaaacttaagaaaaagaagaagacttcgaagaagcgtccagcagagggacccgcgttgcaggaaccttccaccacggtcgcgacaacccaaccctctgggcctaaacgcctgaaattaaacccatcgaagaagcccggggtccagtcgcttcgtatcaagaacaaggggctggtccccaaccggccggtgggcgttggctacgactcggaggcgtccgacacggaaatcgacccctcgatcgaggaacaattcattctgcgcatgttgcccggggaggattgcgaatatctgcagcgcgccatttctgaacgccggttcgatcgctcggaaatttcttttaagccactcacccgtgagggacgacgcgccatcttcaagatccgcgatcatcaatacgccgcagcgctggtcgacttgccatgtatcatcgaaggtatgaagagttgggaccggcgtgggtggtacaaatctgcggatatctgccagatgcttctggtccttggcccggttgctaatgaacaagaggccatggactacccgcttccctcggacattttacacccagatgacaaaactttgcaatacccacacggtctcacgccgccgttgcgatgggtcaggaagcggcgtttccgggaacggatcagcacgcggactatcgagcaggtcgagaaggccgtcgaagatctgattgcccaggatgaggctgccgtggcacctatccgctatgagctggttgataagacagcattgaaccgggctgagggactggtccaaagtggagattacgactatgaagatgaatacgatgatgaacaggatgccgagggcgagatggaggaaggcatggaagatggtggtctgtttgacgatttcgaagacaccctcgctgccgagatggaggctgccttggctgccggcgacgaaggcgagccaggcgctgcggccgcggcaactggagctgagccaccatcagatgctggagtataccaagcgggtacgccaatggcaacgaagccgtccacgcctgcgccagaatcgtctggtgatgagagtgacgggtccgacgatggcgatgaaccggaagacgagctggacgatgagcaactcgagcaacagcggcagatgcagcagcaacgcgaggaaattgccgaactggaggcactgatccgcgccgagaccgcgaagtgggagaagatgcagaacgccatcctgaagggcaaactggccaagcggatccacgatctgaaacaggatctatcattgaagaaggtgtctatcggcgagggcgatgatgctgatggttaatcaacacctcacctatgtgtctctgtctgtgtgtcctaatagccatttattgatttctgataccccattacataccattcaatctccttacacctattctatcctattctttccctataagataaaacagatcatagtataatcaaacaaccttccccgcggaccccctactcgccgcccccaccacatccacctcctcatcctgcctcaacttcctcctccggaccgcctccgtctccccctccggctccgccgggctctgtcccacccgatcccccaacatcctatcgtgcatctccctcttctggtccaaatccgccatttcccccttctcataccccggcgcccctggcccctcggcgctgcctaccgccccggcatgcgccccggcttgtgctctcgcccgcgcatccgccgacttgctctgcactgcgtgcgcgatatccccttctgcgggctgctgctcaaccccgtactctgtgtcgagggtttcgccggcgttgcgcatggtttgctgggatgcttggtgcttggtggattggtcctgggagttggagggttgggaggcggcgttgcgggttatggcgggcagggcgtcgccacggtgacggggaaggcggtcgtattgggattgggatgaggattggttctggggtatgcgttgctcggagggggtgtgggttacggggttgctggcttggttgtaggcggcttgtttggggggttgggggggttgttggtggtgggattgcattgttgtttgggttgattgattgattgaatggttggttggttaaatgattgatttgtgtgtgagtttgtatgcgtagtggtcgagatggagggattgagatgtggtgatggtggtggtgatggagaataactataagagaactgtgaggggatgacgtcagtgatgatgtgatgtcaattttggaggaatgaagaacagttggttctcttggaaatcgcgtagattagctctatgtactgcttgggttgtttttatcatatgaagttagtggtattgtcctgagctggaggtgatttgagatctggttcattttacttggggattcactggtggtgtgtcgcttgtgctgttagctgtcaatatctcccctgactgtatttattgaagagtacatggtggaaccataagggcaggtaatgtaactattcaacataatggcaaacggtaatgcgataattgatgtcaaatatggttggtatacagtgaagtggatgcagaacactggctggtggagtgggtgatgatggattgcggggatggcagatgcagctgtgatgggcccgttcacgccgttggaatttaattttactactaaggactaattgcatgggatcatcatcacgatcagatgagttctacaaaaagcaaatatacacatacacccctcagcataagcatgatattctgacaagaacataactcacatgcagtaaaaccaatctggacatactccaagcgcatgtgataccgcgggaatcaactcctttatttccccagattgaagaaacagatctaatgattactgatcacaactaaacctcaaagtatacaagaccaccatcccatctctctaccatccgcttcaggtcacacacgtacacactcaccaagaaagcaacaagcaataaccctctcccactgtaccaccactaccatgtctaccgcatctctgctcttcaccctccccatcccttccacctccggctccatcacctgcaccaacccatcccccgaccaaccaacaatctacctcctcaccttcacctcacccctagacaaccgtctcactccaaccttcatcgacaccttcctcctcgccctcgacatcatcgaacaccgctaccaaaagggcgtcctaatcaccaccagcggcattcccaaattctacagcaatggactagacctcgaactcgcccaatccacagagggctttctcgataaatggctttggaagttattccgtcgactattaacgtaataccccctcccttatacttcaccactaacagacaacactaatatatgaatactttgaaatacagctaccccatgcccaccatcgccctcctaaacggccacgccttcgccggcggcttcatgctagccatgtaccacgactaccggatccagaacccgagtaagggtttcctgtgcatcaacgagctcgagttcggggtcccgttgcaagcgcccatgatgcatgttttccgggagaagttgacacccagcgtgtgtcgggatgttgttctcgaggcgaagaggtttcctgggccggaggcgctgcgggtggggattgtggatgggttgggaggcgtggaggagactttgaagttcgtgaaggagagaaagttggtattgatgccgaagacggaaatctatggggtgatgaaagaggagatgtatcggaggttgttgggggtggtggacgatcatcatgggaatctggagtggagggagagaatggaggagaggaaaggggaggaagagaatgttgggaggaagagtgtggaggtttgggaggcgaggaggaaggggggcaagttgtagggcactcacggtatcttgtagagggattgcatttgtggtatatatgtatagatgattcatattatgatactatagaaagtgagatgggaatggtggtagtaacttctcttagagtctggagttactactaagtaccagccgaggtggtcgacatatattgaatctacaagaccgatcactgcattctccatacggagcttttgatcaaatagatgtgagacatgtgtgccgcttaggaaggcgacagctaaggatatactactagtataggggagctgaaagattgcttgccagattgccagggacttctcatacttgtattgagaaagttgcaagacctggcaagagatctgattttatcttcccataactgcttcacctcatatatagctagtatactaatcaacgtacactaaagaagccttcccaatatcaaagcatagatattatacccaatacaaatactcacctagcgttcttgtaacactctgatattctgctgcaagaatgaatgcccgtacaccaattcaattccctacagcctcattctcagtaacatatcataagactcaagcaacacagtgagctcaacgcgatctgtattcctacaaatatttcactcctgatctcacccgccactctcacttcacgagccttcatgcactttgttccataaacacagcatggctcgcttgcttgccttccttagtcaaaatcaattcacagcgctggatggggtcttgccctcgcagagtgagttttatacaagatatttaaccattggcttgatgtgctctcaggctcactacaccagttagttatcgctcatggttgtctcgctgcaactttcacagcatttacaagtttgctaggtagttctaccatctcttccatcacaaagtttgctaaaattttcatatcagatacagcttgattcaacatggagagcagaaaacgcaaggccgatgatgaactcgatcccagcattgccgagagcgtgtcagatgtcaatcctgctacggttgacagcgcgcctggggtcgattccatgactgctaacagcgtccctggggctgaacccattacggctgacagcatttccaaagtcgatcccgccatggccgcttacatcgagaagagacgcaaagaaaaggaagactttctgatacggcagggaagggcattgtgggcgaattactggattccgagagaaaaacagctctccaggcctttcgggccactgccaaaccatccagaggtgatcgaggtctggcaacgtaatgaggtaagataggacatggatgtgaaatcagttgtggaggggcaaatcattgacggacagtaggcggaccaagaaactgcatcctcagaattccccccaaatggaataactgataagaaccctcctctttcttacgacgtcatcgcaagtatactctggaagaccaagggtcattgtcccaaggcgcaggcgtggttgaagagccatgagatggacagattgttgcgcggtaatgtgatagtgaggcactatggacgtgagaacctgagaaagcaggcgcttcataaccggtatcagatgaatcttgctctgcagaagttggccatgaggtccgcgcaagaggtggatgatgttaaggaaaaccaggaaaatgaggttactaccccttgggacagaatcttggcagctcatgacagacttcgaaaggcgatgggtgaacctgaggtgtttgcgcatgagattctattgtggtagcaacgcctcctgtcacagtcagatttgcaggcgcatgctagtagccggctgacgtaccctctgattctgtctctttgatatacgtagtaagatgaatgtccattcatgtaccaaggcttggcggttcactggacggttcttgtaactatctttttcaataatcattgatgatcaagtcttcttgtttctgttagttcccttgttctttcccggactctccagcttgtccactagaggccgatacggcgaagctacaacatgctccggcgctctttgagcagtatcgtcgcgtctgggttcaccggacgacggccgcctccgctgctcctcgtgcatcttatccaacggttcgcccacgatctggtatttgttccaattgatggggggcatgcggacaacattctgcggtgtgggcagggtgcctagcccagaataaacgcctctcttgggactttctacatcctcgtcctccgagtctttgtcatgagtgaagttgatgaaagcccctgtatccttagccgacagattccctgctgccagttcgcgggcgaacccttctggatcctctgctgcagctttcttgaacttttctagagtcttaatatcccgcatgctttgctgcttctggagctgaaggatagaaatcgcggatcgcagagcaatggcatccgggttctcgctctccgagatcgggacggcggctggttcgggcgcgaacacgggtgctgcagccggcggggtgaagtctgctaatgaaccataaggaggtactcttgttgttggcgaaggcgacgcagctggaggaacaatagggtgaggagcgccgttccccgtggcggcgttcgtggcaggcacaagatgggcaaagacaggagtcacgggagagtacggcgggcgcggcggagttcccggccgatcaggctgattgctttggttctcctgcgaaggctgcattgcgcggtgttggagagagcagggaccggaggggttgttggcgatgatacgtggtagaaacagcaagataacctggtccaacggattgctggctggatcgatgcgatgatcgacggcaatgacgtctgtgtttgcaactgaggggtttaagggatggtagtagcggtgactgtcaggatgctaatctgatgaaagcgataagtcaagaatactgcccaatatgagaccgtcaatgacagttcatgttgaacgaggcgatgcttgagtcagaagagcgatggaaggtgctggatgcgcttatcgaaggcgattatcggggctccagtgcggagtcaatcaaccccagtcaattgcttgttggtggctgggaaatgcatgctgatggcagtagtaattgtagagcgcatctccacaatacgataattggtatcgactactcttgtattgttcttaatgaatagccagtgaatctctattcagcagcagtcaataagtagtaaataaataaacagtttgatgaatccattctagtgaatgtgtctattttaggaagccatatggcctgatctggtggcctgattgatgcctgcagatttttcaccgccaaatttattcgaaaaattgagggcaaaatccaacattccgtgagattgaaacctctccaaagtctattcagtccctcgcattcctttccatccctttcacaatgaagcgcaagacagatggaagagattccctcggcggcaaagaccagcccgagtccaagaagcgcgctttgtccagcgaagaagccgctgcgcgcttccgtgacggcttgttcgagccgtcggtcctgaaggactataccgagcaatatgcccagtctgctccgtatgtcgcccattctactcttggtctggcatttaacattgagtgaagctaaccccaggtccaaaggtacaagcatggagtcattcaccccctcatcgagccctccctcctgcgcgccgtccgcgacgaaatccaggcccaggtgcagttcaccgagaaggaaaccgacatctacaagatcttccaatctggcgacttggccaacctggacggtctcgacgatgcctctcttgcgaaactgccctccatcctcaagctgcgcgacgccatgtactctgcccgcttccgtgagttcctctcgaaggtcaccggctctggaaagctgagcggacaaaaaaccgacatggccatcaacgtctacaacgaaggctgccacttgctctgccacgacgatgttatcggaagcagacgcctgtcctacattctctatctcaccgaccccgaccaaccttggcaggccgaatggggtggcgcactgcgtctgtaccccacgacgaccaagaaggatgcgaacggcgacgatgtcctaatccccagcccggactactccctcagcatccctcccgccttcaaccagctcagcttcttcaccgtccagcccggagagagtttccacgacgtcgaagaagtctaccaccccaaagacaacgaggacaagtccaagaagcgcgtgcgcatggccatcagcggctggttccacatcccgcaggaaggtgaagacggctatgaagccggtctggaggagaagctcgccgagcgaagcagtctggcccagctccagggccgcggcgacatctacgacctcccgcagcccaagaccgtcgagtgcgagaacgaggacgagcaacaacccgaggaaggaggcaagggcaagggcaaggcgaaggtggaagaggagcccacgcccgaattcacagaatccgacctcgcattcctgatccaatacatcgccccatcctacctcacccccgacatcgccgaggaaatgtccgagaccttctctaacgagtcgtgtctcagtctggaacgattcctttcggagaaattcgctactcgtgttcggacctacattgaagagcaggagagcaagagcctgcccaaatcctccgacgagatcctcgcccagactggatggacggtcgcccgtcccccccacaaacagcgctacctgttccagcaacatggcaccgcgacccaggaccagaagtctccgatccaggaactcctcgacgaccttttcccttcccgggcgttccgcaagtggctcgctcttatcaccggcgcggaccgtatcaccagctacgactacctggcgcgtcgcttccgcagaggccaggattacaccttggccagtggttatgatggagaacagccccgtttggagctgtcgctttgcttgacacccactccgggctgggagaaggaggacgacgacgaggaggaggaccaggatcaggatcaggatcaggaaatgggcgagggttcctcggaggagcagaagaagaaggcggtcaagcccaagaaggatgaaggagccgtggccaacggcgacgccgaggagccttcggtgggtggatacgagatctacatggccggtgacgacgaggaagagggcgatgcagcgatctaccggtccgcaggcgccgacgatgatgacggcattctcttcagcactgccgccggatggaaccgactcagcattgtgctgcgcgacagcggcaccctgaagttcgtcaaatatgtcagtgaggctgccaagggtgaccgttgggatatcacgggtaacctgggagtggaattcgaggataatgatgacgaagacgaagatgatgaagatgtggatgatgatgacgttgaagaggaggatgagtgaaacagaaaaaaaaagtcgtatattttccctcaattgtacatactacgcaacgtgatgaaccccaaaacaatattgacaaaaatagatacaaccatgattccttgtgtaaacgccccgaaacacacactcacacagcccatcacatcccacatacccaatccaatcagaattacatagaagtaggcagcaaccatatacccaaaacaccgcaggatcaatccctaaactttaagtaccctttttccactcctgtacggagtacaatatacgattgtcgcaagtaggaacctagttgtttagcaccgccaccccagcaatcgatccttcgaacgcccaatcgcttcctaaaacccccactcagttactcgctcaggaaaagaattcgattgctttctatgggggtacaactatgcagcctataggagtccgaaagaaataagtagtcggtcgtttggtctcctagtggatacttaaaaacacaatattcaattgtttcgtggacttgtcacattttaatataataatacttggtaagtaggtagaggggtgcatatgggagatattttattttgtagtagatggtaaagatgacgcgatcctgcggtgatttgcgcagggtatatatatatatttagtatatactccggatatactagttgctgttatattgttggatacgtagtgtggtgggtgatatttttggacgaagggggaggggtacttgatgcaggggatggatggatggatggatggatggatggatggatgggtaagtctactctgtagatgtggagtttagttgcacttctgaggccttgtattcaaattgtacaatcactagttgaattggattggtgcctgttgggtagaagaaagtatgtgcttttatatgatgtttgtttctttagtagatgtatgggtaaatggtgtagtggatcggtatgtttattcttaagtgtttttggtctctaggttggaatctgcactagacagttaggatatctgaatactccgtttcagtaggaagttattttttgtgtgttgatagtaattaggagtgtaagtgaatgccctcactttactacaatgtatggcgatgctgagaagggggttccggtgtgggtcttgtcagtagtaagtatttcattgcaaatgtggctacttctacgatctagattactacttatattgtgtctaatggatttttatgacataagtcctacaattatcttggacttatcgaagagtttcattacttcgtatacggagtgtatattttggtttgcaaaaatcggatggagcgatctccgaacgattccctctctgtaaacgtaaatatatacagcaggacccttaaaactagataatacacatcacaaataagttatgatcatgagacacactcccacttcctaatttcctattctgagttattccaactaaagcatgcttgcttctttctctttatacacttatactttttcctcctaacaaatcatccgcggaaataagtccgtcgcagaatggttggatacccggtcacaggagctatttaaaccttctttttctttttgtttctgatccctaagccaggccactggacttttggattctagactttgcatttgctttgagaaatccagactgtaagccctactgcatacttagtttgtcacctgagggataactatttcgttggttgccaccaatcactccgagaattattccaaatcagagcctacttatacttacttgtgccactgaatggcgatgaacagtcccaaatttaagaccccccgttcaagcccgactattcaacttagcatgcatcgggctttgaaaaagatgtgctgaacacgacttggtaaagcaacaccaaaacctgattggctaattgctgtaaccaggaggcgtttcagagattcaacctgtgccttatttcgaggcacaaactgcggatcctccctgagctgagaccctatcaccggagagcctcaccttggcccatgaactcttttgtgtgtcaaatttcggcttttggggctcacatacttggcattatctttgatgatgtatgggtatgagttaacgtctcgcaggattgcggggtgggacgtgctttcttgctggaaacggaatattcaacggagtccgggtccatggacgagactgattctgccaatcagggccatatccgagataactactccctgcttaccttaaacagacacagaaaactgtgctccgtagggctaaaggggtgggaaggaattgagatgactgaagcattgggggccgcccacgtggttttggcccgcgtatactcggaggtcaggaacctggttttcagtgcgtgaaagtggacgcatcgggttacttgtcgacagcctccggtgaggctgtggacgggaggattagttcaattggaaatctcttatgcagttgttttctttttgcgaggggagggggtgactgtatgtggtatgtgttggacgtccgaaagcgccgccggcccctcccactcagcctggagttggggtcggaaattgtgacaggtgccctccatgcatgggcgtcaagcccaccccctgcttttgcgcgggtgatgattgatacattccgtccctattggtctttctcgcccgcgcggtgcaaatcggtggtttgatccagctcagcccttctcatagctatttagtcatggatgctcgcctgcaggcagcgctgtatcaagtccagcgggcgtggttcaaatttgatgcttcccccctgcaaatgaggcaaccgggcaagttccgtttgtctcccggaagatagagtaagctcgataaccatgcttattgaggcgacagacccgagttagggacttagcctcggactgcagagcttattgggcctgtggatcgatcgattccctatgcttagtgtgttgaaggatgcgccggcggcccaaaaagacggccgtggcgactagtccactgtccggtgtccgtttagaaacggaggaagttggtgcccctcgaaggatgcctcggtctattgtcacccttatccagttctgagtgagatgtttcattggtgaggatagattactttttgaccaaagaaatcgatgagagattgagacgaagctgatcggagaagtccgtagccacgacgtccttctccctcgtccatttcctccccggcgcgcgacgctaattcgagctgacataatcctcatgaccacacaccagtgctgaggcgtgtgggttgccttttaatataccaatgtatgcacgtcgcaatttagccgtggggtccagtcatctgcatcggacatggacgcccaggctgtgtgccatgaggcaggttcagcccgagcatgttgggatccagcggttaggactggcttaccctcatgcctaggcctctactcagtactctaccattgaaccacgccaggatagctagtccagatgtggcaaaaggatgtgcatatagtaggccacggtatagaccgggagctgtcaagaatccacctcaccagttcgcaattacttgaccgggcaagaaaagccgcctagccttgcgccaggagccttgcatggagagataatccacactaggtgctgacagcccgacacaggttttgggtaaggccaatgtaaccgtccgggcttactgttatcatgattgagatgccagcggggtgttaatctaatcgagtgagcacggtgcagatttctcaaggtctggcccacgagcggcaggtgggatccatccggagatactaggattagtcgaggctggcagcgtcggggaggacatcattcagcagctgcaggggcggcactttcgtcaagcattgggctagatagatagaaggagggtgaactgtgatttgaacttctcaaagaaggttagttggcgccagggtgaagaaagatcgcttcatggcccatgctccaggcgaacgagatggcagcgtccaaggccccaagtctggccgtgatggatggggtcaccaccggatctataccgggacaggcaggtgctaaaggggccccggtgtcaggtaaatgaaagcacatggcccaatactgcacgagcaaatccccccccggtcaggcccaatgcatccctgtcaactagcagaattgagatgcatagatggtggtgatggccagaattagtctcgtggccgaggcggtgatacaaggactcttttggcttcgtgttacctaaacgaggcccggtgattagttgggcgtccggctccacccgatggggaagccagacccctgtcctgtcacatcggctcagcattgcacacgctgcaggaagcgggtcgaatatggctgaaggcaagtggcagtactccatactagtagttaatgaatattcaacctatctatctagccagtctcgaagagcactagacaggttgaaggtactttgtactttgtacctaattaggggatcgagtagtggtagtactaagtaagtagtagtgggaattgtgagattttgggggggtggtactgtcagtataggctaatcagatcaagaatctgggcggcgctgtgtgtcatctttcattagccgttgagatagtcaatcagttaatccccgatcagaaaacattttcttgtaaagagagttcaatcgaggacatagtctttttttgccgagtggttgtggtggatgtggatatattgggcttgtcattgtaaccacgggacaactggtcagaaggaaatggacggagcaaagccagtcaggatcgaggaatgagagacacaaacagaaaaagaagatcaataaaaattataatatcaccaaactaaccacgaccataacaaccatcaccaatccaagcaaaattgaagcgggtcgttgcatgggccaggattcatccagtccccatccggtccagatccgactccgactccgcctccgactccggctgtactaactttggggcgctcgcgtgcgccctccaccctccctcccttgacggttggctcaatgttgaagccgtccgttttagtgtgccttctagtcgtcctgcaaaagcggagctgctgggcggcatggattgtcattggtctgccttctgactggcacgctgccaaaggtgcctgtctggtggacaatatctagagtccgtcgttgctggtgtcacccgggcttgaaccctggtctttgttgggttacagaaaacaatcggtcgagtgtcgagggtggggaggaggaagaaagttcatgccgtcatcgttggggttttgacatattcagacaggtggccttgatattggttgatacaccccagcttggcgctcaaacatcacagactagttccatttgttccaggtcacgctagcggtaaaacgttgttggctgatctgcaatgggccagcctggggaggttgtaaacgtgggagtaaggggaaaaaaaaaaaggctatggtcatcatcgtacgtagtattgttatcatcacagctgcttgtgtcttgtcatgaaatggccccggacccattcctggtgccatcatttagttagtccattacggcctggttccattgcatcctccgaacgaaatgagtgggagcttccggtgataagatcgaccgttgtgattttggggcttgaaaatcgccctgccaaccagattcattgcccactagtgccttcccctccatcatcttagcgagcagaggcgacaatgtaaagtctcggctaattgactgggtactattgagtgtggtgattcttggaatggagatcccgtcgagtacagtagatcatggagataaaacatcccgaaagggccaaaaaatacataacagcgcgtactgtcgaagtaccaaacacaaaacaaagaaacaaagacagaagcagcaagggtttcgagtgacaccaattcaaggtctgcggtgaagcttcaggcactcaaaatagacgccacattctttcatgttccatgtgtggaaggcagtttgacatgctgcagaaaggtgtgggtgacaaggaagggatggatctggctggtggaattggaaaagtacctcaactccggggtgactgactcgtccagccagctcactggccatggcgattacttaaaaggggatcatatcagacaacgcatggagggcgatcgacatacagcgcttggcaggcaagggcagaaagagagagacaaaaggccaggcagatcatacataagagaccactgtacatgcgacttacgtagtgctttagtgctgctgctattcgcggatgctgcacattgtccacatgtaccttgatgcgcatgtcggctggtcacattccaccggagcggggggactacatgctgcgtgcaggcctcctcctccaaaagaacaaaaccaagtattgagtgtctgataattggtgcctccctgcatctaaagagaattggtgtatgggtgtggtcgctctttggctacaggcggccaaaacccatgctgcagtggctgttatcatgctgtctgacttcaccacccataacctgacttcccccttctggtagtttccaggatgaggtcctccgaggcgcactggggacaccccatggacgcttggcgtcgtgtggctgaaccagtctcaaccgtcgcatgtccagaacccccctctctagcggcgatcattccaccatggttgccatgtgtcgggcgctggaaagccaaacgagttgcgcgttaggccttattgggcattagacttagactttgcgctgacactgagcgcgaacagaaatatgatatgactctgaactgtgacgaaatatccatatcttgttgtatcttattgtatattgaatttgctgctgcccttgcttcgattaccttttatatccatccatcaataccataactagttttggtaaaaatcaaaccatgtggttgggtgtcgggcaggtacggagtattgttagccattaccgacaaccacactcccccagctaagtactaataccatgttccaaacagccgctgcagccactcagatttgtgcaccaagtatctgttgcctacggagcttggatgactgtcccaatgctttctcccatggtgacatagcactccgcggagctctgttgaaagggagtctacagcagacccatgcacctggctactcgagctcaggacctcctcacctgtgggtaggcagtggataaaacgagcatagattctgtcgcatttgccgccctctccctaatcccaggctggatcattgtctgcaaggaggacgatgcaagcaaaaggctaagtgtcaactgctctggcgcgaacggaatggtcccgtaggtagacggagccttcactcgaggcccaatacggtacgcttacgccgcttacggcagttcgccggtcgtgggacccctgaggccgatcgtccagtgcagccacgtgaaggcagttcgcatcgagatcgttgccgaccgaggatggtctctgcttcgctaaaagatcaggcgggcgatgtggatgcaccacctgtctttcgtgatatggcccatccagtacgccattgccatctgtcccccgtcaagcttgaatccttattgtcggatgcgaacggatatgcggtctttaaaagttgcaggctcaaaaagtcctacaggatgctaaacacccggtgggcagattcatatgatgttggagaggatagtaaaggcgagtcaggtgaaaaccatgaaaactgacggagcttatccgattccaaagacacagacccggctgctgaatccagtttagactgagtatttggagtaaccggccgtttgagcctgaataataaacgtacatttttattcagattatccttcctgaagaattttcatttctcttttcgagatgcgagccatgacaaggccatgcgaccgtcggtgatgacgggcgttgattgcaatgatgcagagactctggttcgtgatgtaatcgccagctgcaaactcattgctccgaaagcccccctggtactgtgttattatccctggcatgatagcggccccttcccccccccgcggattgcctgggacaggcgttcaacaacgtgttctcccgtcatggttcgagtaagtaactaaggccgggaattcttcagcccacgggacattttgcaggcgtggagggtgcatttgccatgccagcggccccgacgctgattcgtccacccacgctgggatcgactccccattcattctgggccccacttcccggctggtctgagctacgatttcccccaacctggcttagcttagcgcccaaaggggtagatagagagcagtttggagcagtttgtccctgttgggccatctcgtctcagtagatactatgaggagtagtctagttaccaacaggcagacacaaagttttcccgctggatgggaaagttatggatccctttgcctaggcgctcctgcttgactcgaccagtggggcggccgatgacaagtcttgtttcttcgtcatgaaggtatccaagtaatgaaagaaaaagggcttgcaccttagagaaaggcttccaggctcccaaggtcatcaactgaatccagtttctttccgacgcctgatgaatatatttcgaagaaggagactttactcccaagatatctcacgggactggtgagaagataaattgggggcgtctgagaggtgtgaggcaacctcggtcccgatctgcgtcaacattgccccagttaggttcaacgatgattacccaacccggacaagactgattcgagcttttcttcgcggatacgatccaggatccaaagtcgaacgacggatctctgctcgtttccgggagatgtccaagtccgatcatggatgaccgacataggtacgcaccacaaagtccccattggcgtgatttgccagacaatatcgtatacgtattatgagccagggctcgatggaagcgaccggttgataagctgcaatatcgatacccggacatgggtggaagggtggacaccaggcgccattaggaccaataattccctgcgatggccggggaactgtcaaacgtggctctgatccggccgacaaaagggaaagagaagcagattccttcttctcgactccagcagagctatccgatgcgctaaatcgctagtggaggactaagcaacttcaagtttggtacctgacatttacactgctcgctagccgactgagaatatgactgggctggaccttcgttgtcagagttttggaagacaggaaaaaaaaagccatgttggaaagtctgatgataataatcgaccattcttcggccgcctcctaaaaatgtggcagaactgtaacccacggaatgaggagcagctggaccctcagaaatggccgcctcgtggcggtggacttgatcgctctaggatgtcgtattaactatttttattttagttgaatttacttggtggctgtaagagtatgactaatttgttccccttcctttcttgtcaatttattttattccaatttacttgaaataatattttctgttttacttttttatttcccttttctatttcccttttttatttttatttttttttattcaaatgcttggctgctttccgggcgggctccccttctatgacctatgttatacggctttcctctctttttgtccccgaacttgcggtgcgcctctgaggctatctgtcatatggaaaattgaatagtctgtactatgtttgagccacggagaaaatggtcgtctttagtggctgatcctgttgggatggcttcaattcctgtccaattgctggcagccactgctgaccacgtacggttcaagtagtacgcagcgccaagcgaccttttatcgctccatgtctcttttcttactccgtactttcatacaggactgtacttgtcatgtttctgatacccatcgaggaattttgctctcgtatagaagtagttgtctcatgtggctgagggggaagagcgaaacagaccagactggaagttatcgtcatttacttaagtacagccagccatgaatcgtatgctacaatgatgtacactgaaagtgaaattagtgtagataggcattcagcataagaaaatcgaagtaattatgtggaggggaattctcggatgcaagtgttaatcaacattgatagcttgattgcccttttctcctactcatactaccagcgaaactgaaagaaggacggaagggatgaaagtcggcggcggcaccactttgttcttaaccttcttattttatgttattttattttattttattcctttacatttttcttttcgggaagggggataaaataataaataaattcaattttcgtttcccctttctggattgtccttcagtcgccgagtctcacctcgatatttgctttacatgagaattatcaatattttttattttctcttccagcccttattttaaattctattttggcgttaggtaaaccgcatctgtcactcgatctcgtcattttctatttgcttgttatgctgcatcggtacctttgccttgcgcttcagggccgctccgtactattacttacagactgcttgttcttttactcagttctgacccttttaccccaaggcgaggagggaacatcttcaaccaagaggtagtgcttattcttctaatttttccctcttcccctctttttgaaagccttgaattcccctggtccatcccattatcggcctttttcaccgtcaaaatccgaactgatctcaacatctgacttgatcccattttcgttctatctctctttcttatcctttcttagaagaaaaagacatattctcttttattttaaattctctttcgggtctcttcgtccagacccgcccaaactttctccaaactagtccgaatagctcccgcaactaagaggagagttcccatctcccctagcattttcccgcccgatccatcgaacttccaaaacgacgagacaccagtgccacagtctggttcctgtgaactaactagacgagaagagacggcctcgacgggccacttctactactattattattactgctttcacctatctggtgttagttgagggggggaaagcagaaagagcttgcagtttactgattttctgacgggctggcttacttttgactgctactacttactactttttttccctttactactactactactactactactactgagactccttcctgcccaattgttcgtcgttttaatctcgtgccacgttccgctgcgccgcccgagcgttttgcaccttcgccatctggtaagctccatccagtcctgcaccgcaaacccatgccccggaaccattggccctgccgtacataatttccgtcagccccccatgtggccgaagctgacacgatttgtccctttacttaacatttagtgttcccttttctcctccttcccttcttatttttttttttatcagggagaaggaaagaaaaaaaaaagtcgatttgcatcatacaccttctctccttcgccgatcccagttaatcttcacttaacttatccctcccgtccgcctgtctttcctatccttctcatcctccgtcttccgctcgctttcaccacgacggctccttccgccctcctctcctctccggcagtttttccattttccctcttccgggcatacttttgcgacctgcacgtcactgcgcacttcacgattttcgcatagcgtttttcgccctcgcttctgactcagtgtctatcgattcgtcgataccgtgtgaagacggttcgttgacgcataccaccctgctagttatactcaccggtataaactgtcaggtggagacagacgtcttcaaccctgctgggatctgtcactcagcaccagaattggaggtctttcaggatcagttggaatagcgaatcgccgtcgagaacccatcaacgcgccagtcagtcacctcgattttcggatagtcatacttgcgcgcgccacacgagatcgccattggacacgtacagttggttaaatctatattgcattaatcgaattgccagtcaacgtttgaacgttcactgtcttattacgtgttgtgccgatccctgaacatgagacagcggagcgaccctggcttttacaccatttggtctcgaaacacatcagaatactcctcgccaatccgtctcttctaacaccttcccctccctgatatccatttccttagtatctttctggattgcaggtataccagtcaacagattgtcatggagaccactcttgctcatcgaccttgggagcccgctactacgggaccgcaaacccccccagtgtcgtctacccaaaccctcccatctatttcgactttgacagcaagtatggccggcggcatgcctacccaggccgaaaagtcaccggggaatgcctccctaaatacgatagagcgagattcggggaattggtccatgcctcagagtaccagtaaggcttcgtcttattcattcctacctgcggaggctgattgtcccctagggtcgtctacctactcaaccacgacaaacgcgacaggcaactatccctctctctccttcctcacgtcccaaccttctcccaatcgcgcatcctacgtctcggatcggtccccgtaccccaacgaccactctaataccaacacgccttcctctgcgggagcgcagccttcgcccaatttcgggtcaacccagccgaacacaaccctgccttcgatcaaccagaattacgatgctccttctcaacgaggcagtatggtggaacaccccgagtctcgacggagcagtgtggatagcaggatgaaccaaggaatcagctcgcttgccattaaccccgcatctccttatcatagcacgaatgcttcgcaaacctcgattgtttcgggtctccaacgagagcgcggtatttctatggacgtgaatatgaacaattcctatcgcggccctcgatactctggaggccaaccactctctccacttggcccgcgggctagtgaacatcgcggatttgcagctggccgcacggcacctgccatctcgtcgaatcctcgctctgaaatctacaatgcagaggcacccaccgctggtcttgcatacgctttcccggatcctgacgttgcgcgatccaattctgtctcttctaccaccgaaaagtcaaccaatcaattctcccgcaaaggaagtactgctgagtcacttgccagtagcgtcttctctgatgcacggttacctcgtggacagcatggtatgtcttctgaatcccttaagatatacgaactacgattcctgacctttttctagaacttcctcaaaatgtgcaccatcattctttacaacacaagcaagtccgtggtcttattggagaagcagacgcacatagtggtagtacgccttacagcagaactcccgagctgagggtaacgcacaagttggcggagcgaaagcgtcgcagtgagatgaaggattgcttcgaagctttgcgtgtccgcctcccacaaagtcagaacaataaatcgagtaaatgggagacactcacaagaggtatttcataactatcgcaggcacagccctggtgttgacgttgttcttttactaacgtgcttgtagctatcgaatatatctcacatctagaaaagatggttactaccactcgcagagaaaatgacgtgctgaggagcgaacttgacgagatgcgggcgcaactcagtcagcagcaagccaatggccaatctcggcagccgtcgatctttgagcatcatcccgtaacggtgccacagccgaatgggcaggtacatggcgctatgttttccggttatgctcctggatccgcgatgcagcaagagcaaccgcgaacgcttcctccgctcatgaacgggactgttgctccaatgcaaggcgtgcagtacaccgacgaacgacggtagctaatcgatggccaccgagattcttacccatgacacagcccatgacgaatgcattggtgacggttgctttacttgacacggcccacatttcctcgcgttctagacgcggtatccgacttctctttctctggcttgtagatttgttttgggtggctatcgtcctttcgagcgacaatctgcttgactatttcatcatcctatccaccattttggttggcacaacagcgattcttggctagcctatggcgggtaacaaaaacctctcatcctgtttctctatatttctcacctctccagcatattacccccttggtcatgtcccgttacattacatctcggggtcatggtggcttccacctccccaaactcattcaacccctacccatttttacccctctccccaagaatcggaagatcggggcgtggaatctgtttatttgacctccatcatgtattgtcggtgttgttaaaggtaccgtgtatgcacggaagaagggcaaaaaaggaaactcgaacattagttgcttggaaaaggagtgtatgtgtggcattgttttgatatccccatggtttgtttattatgtgtattttgctctacagatacctggaaatcaaacgtcgaagcatcggttgataccggtcgacatcgatgtcgatcgagaacctgttccacctcagctgccgtctcagtagtgttccggattgagtcgactaagcggagaatctcatgaaatcgtagcttcaaacggccgtgggtgattgatattgttagtaggaggtcagagctacgttggggcatcccgtggactgcgttgatgcaggctatttttgtccctggcgtcttggctgctgattggcgcccggcgaagttctgcaacctcaccggcgtcgtggatatgcttctgttagcgccgcgtgccccccatcggcggctacagagctcccacggcttcttcaggagccaatccacccctggagctatctgccaaacatcatcttgcagagtcgatccaagcaaccctggccaatggagtccccccgtcctgctcgactgtatgaggccggaggatttggcactctgcacaaatagtagccaggaccatgcgggtccgcaagtgtccaggtcaaggatggctgttgcatgatatgcatgagctctcccactcatttctagcaccctgtgggtgcttgggcttcttcctggcaccagctggtcgtgttatgacttttccatcactctcctctttcctctgctgccttccttgtccatgtgctacgtctaccacctcagcagttggtgttcgaattgttcacctgaatttacagttctggcctattcgatttcctttgtatcccttatattcttctcaaaggggaatgtgtgaataacaactggcgttctcgtgttgttctgttgaggctgctttgtgttctgaaggtcattgttccctctggttcataattgtctcacctggatgctttgatcataacaatagcaacccaagcgtcctttgtttcccactttcaaaatcaaaggccatcagtttatcaacgaaaggcttcacaatatcgcagctggtttgcttgatctataccgaaacgaccttcatctgctgcgccagtccgtatacggtacttggcctactcccaccccctgaatggtgtgttactgaaaccagccgactaatgaattggtttagtataaggcagatttttggcctcattggccatacggcccccgagatgcagaattcgacggcaggtctacgaattcctgcagctccgactttccctctgtcatctccgatcacagaggagattccgagcccggtgccatcatctccagaggaccatgacatggaaaggaatcgaccttttgcttttctgaataagacaacacgcagaaataacccattcatacgtgaaggaagttatgataagcacactcagtcacaggaagcagtagatgggacgggggtctcttatcaggcaaatccgaaccaagaggacttaagcaatcttgggctctacacagggaagagctcaggacggccttttgggttgagcttggttacggatttctctcactctacatcaaaggcacctgaagatggatcagtgccgactctcgtggatttgaatgacttgaaggctctctctgaggtgcgagaacaggaaaggaatgcacatactcttaaagggatattgaagaaagtccccggtcaggactacgaccaaaagcccgggaaaccgtccgtattcgacaacaaacgactatcttacttcaacatcaggcggaaaaagaagggaaacgacgacctgtcgccatccgatcgaccgattatgattggactaagcatgccatctgatgaatcgttaagtactcaaggaagagggctaacagtaaatactggccatgcccaacgagcggcactgactccctcgataattgtgactccggccaaggaagacacattttggacaggccttgacacgactcatcctcgtcctaggatagcgtctagcatctactctcaaccaacgccgtatcccgatgaaaatgacagcgaccttgacattccacctgtgcctgctattcctaattatgcctttttggcgcataatgagaacccgagcacgaatatgaacactgactctacacaaaggcaatttgtatccgcagcagggagacaacgctccctctcggctggcactctgtttgaagaagatgacgtgcgacgggagagccgctctcggtcatattccagcgggactgtcaaaaagattccggataggttaagcatcaacactgaaaccaacaggcatcagtcacagggttggtggacttacttgctctcacctttgctgagtcgttacagcacagccatgggtcccaccacccaaactgaggctgccagaccaccagttcccagcatcgcaacggagtcaagggaatcgagtgacgagtggtgggaaaaggaagtatccagcttctcgcccgatacgccagaagccatcatacctcatcataaggaattgtcacctgactggacagatgctagtttgaacccctttgatgagaaaagactgagtattcaagaccaacctgtcgaacgagagcgaaatgccacatcctttatgttcccgggaaggccaatccagggctctgcggctgaatactaccaagcctgcgcacacgaattgttcagcggacggccgtactttgaatgcgtcaaccatgtctgctctataacacccaaggacaagattcccggctataccgagggtacagttgtgggttcctcagataacaggagtcttctgattgacgttggggacatgccacaaaacgaaattcctggcttgagagctgttcccactacttcggagccacgcactgtgtatgaaccgagtgtaatggataagggagtagaggccacccttgacaatcttcaggacgatgatccggttggaaaagctagctcgaggggggtacctccgtctgagcatccaacgatccaacctcctcccaccctgcgtcctctgagcgagtatcctccgaccgagcactctcctagcgaacatcctcctagcgaacatcctcctagcgaacatcctcctagcgaacatcctcctagcgaacatcctcctagcgaacatcctcctagcgaacatcctcctagcgaacatcccccgagtgaacaccctccggctggtcaacctccagtcgacaacaatccaaatcagcctattcctgatgaagggtcacgggaattgcctcaggaagcctttccaacatcacatgccggaggagaaacaggagaattagcaccgcctccaaacagtcaaagcgaaaggaagacgtcttggcctatctttcagccaattatccagccagtcgttcaaccagcaccgcagccagcacctcagccagccattcaaccaataatagtgcaagctcctcaaccggttgctcaacctgcccctccaactcagaccttccatgttcatcctgctactgtcccatcgccgattctcatagcaccccatgggcaccagcatccagcatttcctcaagaacaacagactgaaccacagcctgaaccacagccccctaaccctacgtctcctggcctccaacaagccaccgtgaggggtggctcaattccgctatctgacatgcatactaccccggctcctgcatatacatccaaccacaatagctcctcgaccccagcgcctacatatacttcccactacactagctctatgcctcgcatggagcctcatccactcccacaagagggaatgacacataccaccacagagagagagataattgagatacgacggaaaacgttagagacagaagacaagaagaagaagaaaaagaagtttggcttgttgttctgctgttgctgttgcggtggtaaccggtctcataaaaatggctgtttcggtaggaaagacaaggacaagaaggtcaaacgtcggtggtacctagctatcctcacgtccttcctcataatcatagcgattatcctccttctagtcatgaccttgacaggaaaaggcgactcaactccagtggagtcacagtggctcaacctcaccggctatccaccgatgcccactggtatcgcaacaattgccggaccaaagcctcaggtacagcagtcaggatgcataactccatccaccctttggagctgtgctctaccaccagaggaacaatccgccaacaagtcctacgcggccaatgagccgaacttccgcgtggaaatacgattccgcaacggcacctaccctaacagcaccacaattgcctcacgatccagcaaaaccctctcctcacggagctccgacaacccctacagtccatccccatccccaccaagcatgaaagaccagaccttccttggcaacacaacagacaacaacaccgtcccctacgctggcgaggaaacccccttctacatgaccttcctctcaaccagcaccctaacatccacatccacccttcgcctggcgcgaagatcctccgacagctccttccctaacctcgcaacaattatcccctccccagacgaagattccgacggaaccgccgccgccgcagatctatacccaatgccctcctcccaaccagtccgtctctacaaccgcggcctcaacacagaacactacggcttttatacctacttcgaccgctccatcttcctctcctcccgagcccccctcgacggcaacacaaccgacacaaaccccaacgaccgaaacggcggatccaacgaatctgacgcccgcgtccgctgcacctggtcccagacccgcttcctcgtccaaatctggacgcgctccaacgacacactcctggagaatgcaacggccacgtccactgcatcagcaactgcatcaacagcaacagcaacagccacgacaacgccttcctccgcgaatgactggacccggcccggatcctttccttaccctgtcaccataactctagaccgccatggaggagacgctaaagaaaaaatggtctactgttatggcatggagagcggcgagcagatcaactcaacggaagtcaagttgcagcttgaggatcgatcgtacggtgggacgctggtaaatccggccccggggattttcgacttatatggtaattcgtcgacggacgctacgggggattatgggggcgttgatgggggaagtggagggtgttcctgtaagtgggcgaattgggtatcgagttcatgaggggttgatggtaggatgaaaaggatatgacttcccaagttggaacgaaaagaggaatgacatgtcagctttagttgtcttggttgatgattgcatatatgcatatatgcatggttgcatctgtatgggaagtaatgactcgaagatgataagtaagcttacggtgcagatgcagtataatataccactacaatagacgcaaatgtcatttctttccctattattgatgataaatgaatttaccgagtctaatacacaatccatatacctgagtactccagaacccagaaaggaaacaaaagttcagaccggaaacaagataaaacgccgtatatacctctagaaattcgattccaacgaagcgacaatctggtttttgaccagagtacaatatcggaatcaacgagagcatatattaattgtattgtgaaggacacctggaacaaacaagcaaatagaaatgtatcataagtgagcgaagcgatccacttctcgtcaatagtattagtttttaaagagtttctgggtgtaataaacctgcccacttcgttgtattgtattttttgtatcggtttcggagcggtggtcttgccatcaagcagtctagtgatgcatgatatcgaaggtaaaatcagaagagagacagtagcgtcatttaagccaggacaagcaggcccatggcgatgctgccgacgagagcaaggccgggaagaaccatcttggcaccagagctggacgagatgaatcccgtggaggtaggtgcaggaacagtagcaccgccgttgccgccgccctcgccgccgcctccggaggtgctggtagcaaaggaccctgaagaggtggtcgagttggagaaccgctgcgatgtggtgctggcgttgctactggcggccggggggatgctggcagcaggtgcactggtcacggcggggttcgactcgaccggtgctggtgggacgctagggttgacagcagccggggcactcgtttgagcggccggtgtctccgctgcggaggtcttgatgagcgggacgctcggttgagcagcggtgccaatcccctgggtagccggggcgctggatccaatagcggcgggcacagtgttggtgaccactggagcgctggagccagtggcagcgggctgagtctcggcagcactggtcttgatgactgggacacttgtctcggaggaaccagaagctgtggggctggactccggggcactggatgcggcaatgggaggcgggtgctggacgctggattcagtaggttgagattcagcactgctgggctgcgcggtgacgacggcggtggtttcgacggtactttgggcgaccactgtggtcacttggccgtcgtcactagcagactggcttgcgtgggcagcgccgactgcgaaggccagagcggtcacaacgtgggttgagtaacgcattgtgaatggaggagttttgagagaacggaagaaagagatctatcgcggtacaagtagcaaaacttagcgtcaagaagaaagattgaaaggtagagaatgaagcatggcaacgcagacggatcgagctggatctcgaggttctttatagctttgcttgaggtaccattccggtactaccatcattgcttgacagtcggtttaaactccgggacaagtgcttcttcatggtgccatccacgaatcgcaagaggtttagggatccggatgccgtagtgtggaaacgaacgtgggaagctaggcactgcttccggactagatcgaacagattgaatctcaaaatagcacagctgctacccaaagcattgacagccacccggatctagatagactactcctgctggtagcagatccaattggggctcttcccaacgtcatgtgacttgtggctgccaccccaggggttcccaaaagggaagtcgagtggccggaatcagccagccagaggaatgttgatccattcttcaatgatctctagccctgcgaagagaatagtatcgtcgaacgcatttaggaagtgcaatgaggaagcagcaacgtctcaacagacgaaagcatccccaggatgctgtgagctacctgctacgtcaacctcaccacgttgcaatctcgactgtggcatgtttcgcaagtaatgtgccatcggatgtttcacacctaaatgtcgatcgattagcagtctagcagttcaatctagcgaattctgattgtctctcgactagtgactcaatcgtcttttgttagtcactgaaagcctaagtggtcaatcatcggggacattgttgcgaccgcaactttcagtgctaccgatgctggactgggcgatgtacaggcactgccagtctttgaacaaggacagttcgtttaaggctcctgcctgtgcaagccaacctccccttattcgtctgtgctttctgattgctcgatagcacgtttgtagttctgttcttccgctgatcacccaatgcaagctgtcatgatgaagacataatagctttacttgtcaaattagccagttatcttcaagctagggtatgccaacgccttggaggagaacttctttgtgaagcttcaagcataatagaggccactggtctcccccaggacccctttgacagagcggcggagagttgacgacgcgtgggaattgctgatgtcagttggtaggagacggtcaagcttttacatagatcagactccaagagggacaaaatgtcatgttagctcgagaactagtcctgctagtagttatacagagttgaacatatccatggtgtgggggaggacagacatgagctggaccggtggttcccattcggcaccggcccggagatccgccgatcgcctccccctcgaggtcaataatccatgaagccgccatcctttatcatccccaagttcctcactatcttccctaccaacactccatacgtgtcgccataccggctccaaggtcggtcggtttctcctccgtgcctctgcactccggcctgatgccaccgcccgtcactcatgcctctccgacgcaacattcccacttcctcccttctgtctcccggcgactatgacgaagatgccgagtcgctccgctccccgtcagagcaggactctgactcggaggacgacgaatttcttaggagatcacgcaccacattagaacttgccgaacatgatcgcacagtactggatgaggaagaagaaacggagaaactgcttacccgcaccggtccaactcatggccttcgccgcatcttcagccccagcagcagtagcgttcgaattgggaagcaggagcgcaggcgacaacgccaacaggccagaagagaggcccgcaaggagcgccgtaggcaggcacgtggatccggagagataatgtttgagatggaagagggtcaccgggatgatgagcactctctcctgagcgcatcctcgtccgacttcgacacacgggtcaaagaatatgcctttatgcaggtatgaatgtcacatggcaacctctcatgggtttattggctttgccggagctccggtactgacatcttggtaaccagccacggcgtgtttcatggcgcagactcgcgctcgtattttccgctatcgttgtccttctccttatcttcttactaggcgcatataaagcatctacgaagtatcgcgccccccatacctcgaggcaacttctatctaatggcactgctttgttcgcacctacgacgatcttgatttctctagatggttttcgagcggactttctcactcgtggcttgacaccaaccctccgctcattcattgcaaatggcgtctcgccgcagtacatgttacccagttttccaagcgtgaccttcccgaatcattttacactcgttacgggactgtatcctgagagccacggaattgttggaaatactttctgggacccagagttgcaggaagagttctattatacccacccgtcggtcagcatgcaaccaaaatggtggaacgcagaacctctgtggatgacggccgagaatcagggcgtgaggaccgctgtccatatgtggccgggctccgaggcacatattggaggcgtagatccaacctacctcgaccaatacaatgggtccgaaatgctttccttgaaagtggaacgcatcttgggactattggatatgcctggagtagaagccgagtcagacattgcgccacagagacctcagtttatcgctgcctatgtcccgaatgttgatgcagatggacataactatggccctaacagcactgaaactcgcaacacaatcgccagggtcgacgatatgcttggcagcctattttccggtatcgaagcacgcaatctaacggatgtcgtgaacattgtgattgtctccgaccatggcatggcgacaaccgcgaccgagcgattggttcagttggaggatctgatcgatattgatctagtccagcgcatcgacgggtggccgttacgcgggctgcgtcccaaacgaccagaggatttccaagttctccaagctcagttggagagcgtggccgcgaactattcgcatgcggtcgagatctacacgcgtgagggcatgcctgaacggtatcacttccaaaacaatgatcgcatcgcccctctctgggtaattccaaagacaggatgggcggtcgtcgagcgtgtcgactttgacgtccagaaggccttggagaatggggagatatatcaccccagaggcattcatggttacgaccacgagcaccccttgatgcgggcaattttcatcgccaggggacccgcattcccccatgaaccaaacagtcgcttggaagcatttcgtgagtcatccatgacccttttttcgcacggggttggatttgagctaaccaatgtagaaaacgtcaatgtgtacaacattatttgcgactcactcgggatcaccgcgcacccgaacaatgggaccatgcgcctccctctcaagacgataggccttcactctgacgaagacacgcccacgctggccagtgttccagaccccccagtttctagcacgaccgccactatgacgccaacgatgttgccatcggcagagacttcctcttttgcgtccccgacggaaacggcgcctgaagctcagccagagcctgacccggaaagcgaggatgagaagggcccaacctggtgggggaccctttgggacaaactccaggaagccaaggagtgggcaaccgatatattcgacactgtgaaagacaatttcgccggatcatgatcatagacatagaacgagtggctatgtcattgttttctttgcttgttggctttctggtgctcttactgttggttattctgcgaggcgcggctttttttggtttaaaggaaggggggccataacccattaatacgtcataatcaagatacccacatttggattttacagactacgattgaatacaagaaagacatcattggctcgcagggggggggggtgtttctccgagaggaagatggggatgcggctgaaaagggagaaacccacgatcgccgggtgagttgccgggattggcgcccgcctgcttatggcgatgactcaagtggctccccgtcagctgcgcattccactgcgccagtcacttccttcgttgggcgcggttcgtcagttacacactggcctacacgatgggtcagagactcgctctagatcctgtgcctaccgctcggcgcagatggatgcctaccaaccccacgatgccacggcttgtcagccttcctgcctggcgcatcatggctgggatagaactataaaggaagagctcattcttgacaatgaaaagccttttcatccaggccaattaattgcatttttttccttcaacgtttatttccagttttctgttatagagctgccggttagttgcatattattgttgtttgccgctaaagattcgtttatacacggttaatcccacgcccacggcattgttcgcatatgctggatttctctatataacgtatccctacgactacaaaactctcaccatggcttcaagcgcctttctcagcaacaccatcaacaacactccagtcatgaacgcaacatcttcctcacagtatatgaatccttccgacagtgcgatgttggatatgttcattccgggatactccttcatctcccggtttttaatatcatatttacacatcgacctctcccaatatattcccatgattttgacagccgtggcttttgtcgcttcactgcgatatgtgttctcccgctcccacgagctgttaagtgactactgtgtgtcaacagctgagatccgcctcgaggatgaagtgtacaactatctgatgttctggatggcgcaacacccctcgacgaaacggtccactcaattcgtagccagcaccaagatctctagcggcgcacgatactacgactccgacgacgagggtgatctagacgacgaagatgaatacgatgagaatggcaacgtcgtctccgacttcgacgactactgggccaaaaccgtcgcacgggacaagttcaagcgcctgcgcttcactccagccgaaggaagccattatttctggttccgcggtcgtcttcttaccttcactcgtgccaaagaggaaaacaacaacactatctcctacatgcgatacgtgcctgagagacttttcatctcatgtttcggtcgtgatcccactatcctgaaggaactgctcgccgaagctcaaagggcatgggtagcaagagacggaaacagcacagtaatctaccgcggccaaaaaaatggcggatacacggactgggtgcgctgcatggcacgccaccccagacctctctccaccgtcgtactagacccagcccagaagcagtctttcatcaaagacatcaaggaatacctccacccccgcacgaggagatggtactccaaccgaggcatcccttaccgacggggttatctcctccacggtcctcccgggacaggaaagaccagtctctgctttgcagcatcagggctcctcggtctgcctctatacctactgaacctcagctccaagagtctggacgaagacgacttgatgtctctattccaagacctccctcgacgctgcatcgtcctccttgaagatattgactgtgccggaatgacctccaagcgcgcggccaacagcactcaagacgacaaaaacaagagcgaccccaacaacgccaataccaacccagccgctgctcccaacactgccaccaacactcccgccggttcctccacagataagaagccctctgaggagaccactgataacaaaggcatcaccctctccggtctgctcaacgtaatcgatggcgtcgcagcaagtgaaggccgcattctcatcatgactaccaaccatccggagaaactcgatgctgcgctcctccgtcccggccgcgtagacatgaccatcactttcggatacgctcattcccaagacatccgggagctgttctcgtcgatttactccacgcttgagggtgacttgcgctctgtgtctcctaacaggaggaaggatgccatcaccagccacgacggcaaagccaatggtgtcaagaaaacaaccattggtgatggaatggaagaacggccccctgtttcggataagattgtcaggttggcgaaggatttcgcagctggtatccctgctggggaattcactgctgcggaggtgcagggctatctgttgaattataaggatgatccggagggtgcgattgcagggattggggggtggttggagcggacagagaaggtgagaaaggagaggaaggagaaggctgagaatgggaagaaatagatcttctgttctgctcatttctgtgggttacgatgatgattatagatagtagagataccccaccctactcttaaagaaacttactaactaatatgaatgatatgcatgacctcattaccatgtagaagatatacagattcacacaaaatccaggacaataaataacccttccaagccaccaatatcaatccgaaaacgaacgtggtatctaacaaatatcaaacacaaacacccatccagaacccaaaactcccaacaccacccacaacccaccaaaccctcacattgaactactaacaacctaaacaaactccacctccgtccccgcaatcctcacctcagccgcgtacatacacctattatcaccacaaaacccatgaaacagcatgcgatccccacacccacaaaccgtcccaccccccggcgaaacaagcccataatccccagatttcaccaactgcctccccgtcttcgtatacggacccgtaatctcactcgccgtcgcccaccgcacatcatacttctcatccgtatagcaatgcgtcgagtaaaacaaaaagtacgtgtccccatgcagaatcaaattcggggcctccaccaacggcccgtcgctatcatcgcggtccaggatctgcaccgcgtcgccgacgggggtaaacccgtccgtatctactttttggagaagaatcggggtgggtttcaatggcgcaatgccgttgttgcagtccccgccgttgccgatgctgttgccgtccactttgaacacgacgtagcgtgagccgtctttgtctaggaagccggacgcgtcgatgctgccgccttggtcgagacggcaggagaggggggttgggtttgggatgtagggcccgctgggatcggtggattctgagactgcggtgccgatgcagtggtggcggagcatttgttgtgcttcgccgctgtagtagaggacgtatttgccgtcgttctgggggtggtggtggtggttagtttggatttgggggaaggggatgggatgggatggggaatgtacacggcggactacgtctggggcccagtggtcaatttgggtctcccagcctgctaaagtggggagggcttctttgtcgaggagggtccatgttttgaagtctgcggacttggctacttgcaccgtgcggttgttgccgttcgtcccgaaggcgtaccaggtgccgtcgtcggcttggacgaagccggggtctgggaagtccgtgtcaagggctagccagggtccggtggctcggatttcaatgggtgaggttatcacagatgtgattagcgtgaggcctagggcacagagggatggtagatgggtccacattatgttgtctcagttagggtggttatttgggaaagaaacatgtagtagtaagtgttactgtaaggagtctgcaggctcggttggggtaaggggggttgctgttatatacaggtgcgatgaaaggtattaggcaatgctactatacactgggatgaggcgtcgttgctttatatctgagcgttctgagctgggcagtaagcagggcccacccatgtgtggatgaccgctttgaatgatggatgaagtgctattccccattctgtacaagagtatcgatcatttgatgcccagtgcttgcgggagggaatctggtctgctggtctggggacgggatacatcatccagctggaattggcctagggcaggtgctagcatggacttgagatgcgcctatatgcatattcggaatttagtggatcatccaggtgagctagcggaaaatattgtattgacttggcatctttaatgactgatgtggcggtgattgagtgctctcccttcatgcaagtgccgcaaggctgcctctggatttatgggccaatagatgccactgaacttgcactcggtcactgggacagagtatttagaattggagggatgactcgctttgacaggcagtccatagtgacatgttaacccaaccgagcgagtgcgatatatcggttggcattggatgagacgaaaacggtagtagcttggccatttgcctcggcgcagcaacaacaattgggcctctgaataacctactagcttcgttagtgttcattcgatcatctggggatggacccacttcattgagtaattatgctcggataaaacatgattatcctagtcgattcttccaggaacattagtattagagccggttgaggcggagacgcaagggcagcattgatcatcaagggggtgagagtatgatcatgccatcgaccttggagtgaactgttgtgcttcaagcaggctgacacaattgcccgtagattttctaaaccgactgcataattcttcctagcctgatcttactgcatgatgcatggctgggggcccctcctcaccatgactcgatcttcctgttcctggtagggacgtggaggcagctattggcttcagccgctaccgaagttgttcccatggatcgaatttttgggacacggcatcccaaaccttgtaacaagatctctttcagggccgatactgaaggccaggacccgtattcgacgcttagcacaagtgcaactgtcttcatataaaccggttcattggtgctttctcacacccttgaccatttccatcctccagtttatgcccagatggatggcacatggggagttgttcggtgctgcatgacccagcatttctcccgttcgctcacctacttcatgccgagtaacccagccagtggatttacccagaaaacaccagacacatggcaagaggaatatctgtcgtgtgtgtgctatctggtgccctttgttggctgtccgccaagtctgggtaggtttcttagccgggaggccatacatcgggtgctctttcaagtcccaaccttaacggccggggtaggtctcaacgtagcacctcagcttccacccttcacatgcaacgtgtagaggccaaggatttagcgatgccatgtaccgctttgtactgggctttccagaaatctcagatacgatggcaaccgctgcgcctcgtcccttgcctgaagaaggtgatacctacccgaaacgtcacatttgaccgcttattccggcgaagaacaccctaacaatactccttaagattatcaatgatctgcctcatttagggcaatagtttctttccatgatttccatgatgtacaaggaaatcaacttagtcggtgaacagtgaacggtcggcattcaactgattggtccaagggttgagcctcttgggcccttgagacccgatgtacagggagatctgcagggctacctcgtgttcccatcaggtgaacaagtgggcctcgtgagatcctgtcttttcaccgaatcctaaaatcttccctcgacttaccccgcacgagtacccgattgaaggaattgatcacaaaacggctcatgggcggattctcgtggccgtctcagatcccgggaggggcttggtggtgggaaactatatccctcactaactcttcatggaagcgtggggaagcccgattagtattagcaagggtcttcttcaagtacgatgacttcaaagatcggcatcgggtagcgtgcaacttactccagataatggagagccagtgagaggtgagatcctgcgggtagtctcggatacgaagactccagtcgtgcttgagattcctactcacaccggagttgccgtgactttgatgcaggaatatcgggcagatgtatttcttggagggatctgttgggttgacatgcgggatgatgccataagatgaagtgaaggaggcgaaggtggaagaatgaagtcgtgatggtcagctgcgcctagtccctttccagctacagcggcatttttgcagtttctctcacactgaaccaaacaccctgagatgctaattgttacaaaagtcatcatttcttctcataactgactatccacgtccttctcatataagtcataagcgctaagaacctcacatatatacacccactaacgccataacatgcacatagaacagacatctagaatcctgtaagaacccaactttcaaacggcacaccacgaggctgtctcttgccattttcccgcgtatacaagacgggctcatactcgcacgatgcagcatactgtcgaatcaattgcctccagtagcacgactctgcagcaggagtcaaataccgatcccgaaacgtcttcacagaattctccgcaatgcgttgcgcagtctccggattatcaataaggaattccatcttccgatcgagatccgaaaagtcacgctcgacctcaacataatttgcctccggcccggacgcaatgagcgcagcatggtgtgcctcgcgccagaccagcttatgcgaaaccaccacagaacgacaattcagaagatacttcccgcgccctgagaagctgcgtccttctgcatgtgccaggaacatatactggcagtaatcttccatcggaaggaggttaaatcggacatcattctcattatcccagtcaattacccggatgcttgcccagctcctaccctgcgctgccttcaacaactttccccggatctcggggttcgtagcaacactacctctccaggcgagctgcttcttcttgtcctggaatggtaaccccggtgtggaccccccatcaatagtcacttcaccgtcgtcgactgcagcaatgcggcggcgaatatccttgtaggggccaatcttaacctccggccacgaccagtatccgaagtcgggcattaaccagacattctcctgctcgtcctgtttggaataagaccaaactggtccctcattagtgctataatcctccgtcgtcaggacgaattcaatatccggcagactgcttcggtctgggaacgaagcgagtgcacgatgaagcgcatgtaatgttgcttccccgcgggtgaatgtcgcgggcattgcgccaaaatctactacatacagctatatcgcatcaagtcgttgttagaagacacatcaaccatcgtagatgattcaggttccaacatacctcaccatgatgaacaataccccgcaccatcccatcctccacttgcagactatccaactccttaaaagtaatgcgatggccttccctcagcgacgcagatttgtccagctcaacaaacagcttcggaaacgcgaggcgacattgctcatctgaaagtccatgattgtcgccatcgcgctcgacaacaaattcccatgtcgtaccattacttgcttctgatggcgaggtgttcaagcacgtctgcggggctgtcttgagggacgacttcagggcatacttggcgacgtcattggaatattgtgtgctgaagataaggaatgttgttatgatcagggagagaatggccccggtggctatgaatcggaagcctgacgactggcattgtagtaattgcattactgcatcccttttggtactgccacttggtacctctgcgatgatcagtgcatgtactgtggtagacaggagtagttaactactagtcatcgggcgggatattgaggtagtcgctgtaagcgccgtcgccatggcaacgaacgcccaataccatcagtctcaacctgactctatgcctgcgagccttctgtctgcactctagaacactgtcactcaattaattatattgtcacggtagcagtaatcgcccaggtggcttctcctgtttcttgagatatgagcgtgaagttggtgttgggttgtcgtggcgatggaagcgaatagcaacggatagagaagcagatggagacaaatggttcgacggtgataatgcccagtaatggatttgcgaagccagagacaaactaagcgtagaggcatttgttgatcatgcgagactggtgaaagaagagaccgatgggtgcctgcagaagcgaagagatttcggcctcccgctcgctcatggagataccaagcaggtgtccatttcagtctcgagatgctataccatagttctaacatgatacaacaagacagtcaacaatttgtatatatatttttaattatctcactctccaagaataatcatcaacagataagtgacctactgcccgcctgcggacacgctgagccctccctttcttgtatcacggcatgcaggctggtgtgtatctgtatctatagttgaaaatttttccaaaaaaatgtatgtacatgggagttgatggaggccataagaggcaaatttattcaggggtatctcaaaatcaatcaagaacgggtgtggagtggaaagagatgtgtgtcatggctcaacgaaggaacaccaggcctgccaatcggaaacgcgataaaaaggaataaacggtagaatctaaatgtatggttgaaaacaaatgctaacagccaccgggagggtactatatgcagggtcggaaaacggagggttaagggtagagtcacatcacggatctccatgagacctgttcaacaggcggggaagacgcttgctgggtcactgctgtaaaggcagacatgaacttcacgcattgtggtttgccattgctctggcaccagggctgctgaagtaactttcatcgatcttcaggatccattccactttctgggcctcggttcgggccgcaaacaggaacgtgttttgtgccccgtacactgcaaagacattcggacgaccccgtggagacccccggtcagacccggctgctcctgggccatcgaggagccgtgcgaagtcgggtgcatgatcaactcgggaattgcgcaggttgatagcgttgatctcatcaccgtcaggaacagaatagatgtggagatatggacgacgaagctcaacaaaacgccgtacccagtggctgttggtatcatcgggggttaagagatagccagacttcaaagatgaatcattcttcggaagagcttgaacgctggcaacaaaccgcggcttcaatgatgcctcgtcctgaaccgagcttccatcatcgcttgaagatgattgcttcgcccgcgaggcaaaggccgcccctcctgcaggcggctcggtgttgcttcggaccaggattgcctcgataggatcggtctttttcccccaaaggtcgacgtacttctgaagcaacttagccctgcggtcagcacgctcctggctacggaggggggttgaccgtccgctgcgtggaggcgacgcaacaaggctgttggcactcaaagcccctttagctgcatttaactcggcaacacgtcgccttcgtttgcgagcggctatataatcacggacaagtgagactttgcggggagcccaggtaataaggagctcttcgcccttcacatagtcgttctgtgtgttcatccgccagagatcagccgcacgtttggcggacactggacggacgactagagagaacatgcgaactgtggagtgcacaattcgcgttgaattgaagaattgcttgaacatggactgaggtcgaacgtaagttcggccttgaatctggagggtcaggtctatctcaaaggggacgggatcctgcagacgggaagacaacaaatcccatcggagtgtcacctggacacgatacttgtctgcagtgacccgatctagcaagagagacccgtgtaagctggagtcccattgacctatgatggtgatgtttgacgtcccatcggcgttttccttcacgttcggctcctggacgaacttcagcgcaacgtctggcgtctgcaagtcctgatcagggatcttgccccaaggatctagcaatcgcactgaccccacgcggatattggtaatattgtcccacggcaggctttcagttgagctgtaagttagattcaccaggacccgccgctgcaaaccctgatggagctgatacgtgcctgcatcgaggctgttgctctggaccacctcgactggaagatattcaccggactcggctaattcgagcacctgcgccctggcgaaaacatcatgtctctcttcggaatagaactccgtctccgcaatacgcggcgttttgcgtttcttgggagccggctctgcagagtcacgcatgtcatcccagctaaggagcttgtccaaatgcatttgtgtcacctttgcgtaaacacagatctttagtgctgccgtccgtggacttgacagcggcaaactcatactatgaacgctctcaaaccgcacaggtgattcatcgaagcccgtaatcatttgagtagtcgtagctcccccttcgtcagagattccgggtacaaacaattgcgcgtggacgtccgacccttcccattcagcgaagccaaccatatcccgcatcacgacattgaacttgagagtagacgaaggcgcctgagccgaggagggctctaatgacagcctaataatgcctatgacattttgtgtatatggcgaggtaacttcaactgaaacgtcttggactcgggtctcaaagacagccgtgagagggatatcggcgtcaccaaccagcgaatattgaggcgagcacggctccgagaaggggttttcaagcttgaaatgctggatgtagtctggccggtcgatatattggtgcaattgccgcatagcctgaacacggcgttggagcttctcgatagaccataggtggatgacacattgcttgaaatcaatcacacgaactgcgacacagggtttcttggcctcatctagaacaacatcctcgtctccagagataccattcagtacaaggtcgtaggacgaggccatgttatgcccgtggtcaatgatcgcaaactgaaacacgacattcttgtccattatgtggctcatcacttgggcctccttcaacaaagacgcatgctggagcactttctcggccatgcgaacgtagttttgctgagaccagtggcggtagactgttttagcgacttcaagctctctgtcatccagcttggcaaaaccattctcgtagattttgggtactggttggcctagatccttcatgtgagactcaaaagcctctttctgctttttcagttgctcttcgaattcttcctttgcagttcgcagggcttcctccattcgagccttttcggagcgtaggtcatcgacaccctgggtggaagaggcctcggcattccttaacttgtcctgatactcctccttttgtcggtccaactggcgctgcatatcctgacgcaccgattgcagtgtagcttctcccccattctgcccgtcattctcatcattcggatgcggagttccaggcatcgtaatggcagtgtccaatgagaaattatcaatcgttccgttggacatgtacttatcccgcactgggaacgaactgagcgagtcagagtcttcctcgttctccatcagcccacgacgagttgcccgtactttctgtacatcctcaaacaaggcgtctagctcatcgtcaggcatatgggagatttgatcgggccccagcaccgcactgacggcttcacggcgagcataaaaccaatcagattccctaccgcgctgggagggcatcggggaatctgctctgctcgaatcgccgtccacctccgagcctgtcttactcagggttcgatcgtgggttttattgggcgcgggtgagcccagttgacttgtggtgacggaatgacgcagcaagctttgttcaactcgttcagcacgcgcttcctgggggtgattgaaacggaagatatggaaatcacccaggataatgcggaacccactcttgagtcgcttcggtttatcgattcgcaatccattcaccatgaccgctgcgccttcggtggggataatggtgacaacattgtccacgttctcaaacctacaatgatcgtctaaaattttcgagccgttcaatcttatttcaacatggctgccctggtccatgtttccgactatggtggttcccggcttgatgttgtaaacgagacactcagctagcagcgggtcgtcgctcagattgaccaaatgtggcatcttcttcggcgtgctcaatccgatgaaacctttctcgatgctgataccaagttcctccagagcagactctcgctctttgtgaatctcttcagtctttgccagcttctcctcccaagtttgattcagatctttgtaaagcttctcgctctggttcagctgttcgacgatttcagccttgctaactttggtgatcgaaccatccggctgttgtatagagacgagttgcttctctaggggggtatctggagggtaatattcttctgctggtatagcaccagcagcgctgcctgctccaggacctgcggcaccaccaccaagtttcgaccggagttgggccaactcctcctttaactctctaatcattcgtgcgttggggtcttcgttcacaacggcatgattcttgattcgcttcgccgagtctgcataacggagagtactgagagtctcctcaaagttgatgtcggcgggcgaaatagcagcaatcatcgctgtcatggagttacctcccaacgagtcctttagcaaccatgtcaaaatggaatcacgatatggaaccattgatgcgttcttctttttgccagccgccacgtcagcgagagcggcaatgacacgaccaagggtcgacagcgaacggttaatttccgcaccctccttcagtctcgcaccggtcgcgccagtagaatttgctctttccgaacctgcaagatcgactaaactaatgcgcgacaccttctccgtatccatagacgtctccgcgtcatggcgcttctgtgtgagggtcaaggtaaacacggcatgggaacgactggacgtctcgttcatgtttgtggcagcaaccgttctagccttgttaccctcgtccatcaaattctcgatctcctcaaaagagcgcactacaagcttggccaggtcctcgacgtagggaccagtcgacggatgctcgcgaacctttaaattgcccttattcgaagggttgagcaaatcacggactctctcattgtagatttcaagatatgacacttccaccgtacagccgaggttcttgtcttgctggattgaatgaatgcgctcgaacatatcctgacaaattctcggaatcacaccgtactctttgccgtaacccatcatcgaatacgattttccggaacccgtctgaccgtaggcgaagatacagttattgtaaccctggaaggcattgtctaatagcggtacacccaggtcgagaaacaggttatcctggctcgcataatttggggcattcttgtcgaaagaccaatacgatctgtcgaaggcgaatgacttgggtcctccatccgcgcctttccctccaccagccttgcgggctttatcatccgcgcccggtggagtggaaaggacggtttggttgtctttcatctgaacaatacattttgcaccacggtcgatttctagaatgcgggaagaagacacgggggtcagtccagtctaggagaggggcttggtcgcattgccaatgccacaagtgactcacctctgctgttgaaaggccgcactcgcaccaccaccttgatgtttcctccaccagccatggttgcttcctccccatacacctgggtccgatcgcctggttccgcgtgttcgaaagaagaatcgcaagggggtgaaccgacaccagcggaaaacgcgagtcgcgaacgctacgaggagcgccgccctatcggatagtgcaagctgatgtgttcctggtttgcggtacttgtttcaatgctagttgagttattgtagtaaagtgttactggcgaattgacggtctgaaacggatgtcaacaaagacgtcatgtatatcgggggggttctgcgggcggacaatccggcgcgttctaaggggtgaaatcacgatgataacgggagcggtgggagttgacggtcgtctgtagcgcaaccagaccggtccaagaggctgccaggatcgtctgcgtcgaggaaaagtgaagggattggaaagaggaggcggaagataggccgactcggtcgctctcgctctccttgccccaagcacggggaaaagccacatgagggatcgaaagggcgggttcgaggtggatcacgtaagcaatcccgtgtctctgccagccaatcagcaatcccgatatttactccggactcatcaagcatctttttccctttcctgccactgagtggatgctccctctaggtcctcattcaccctgcactgttatgcaggcacactcttctccatcggtctgctcgagctcctgattcgcttcataggacataaagtgtctgatcgatctcatggttcagaagcagtcgctctgcaataggcccccggtgatggtgttgcagcaagcttctccgcccgggtccagggaatccatccactagctagcagggccagtgtgttggtagtctacttcacacatagtagataggatttcatagatccaagcatcaaatgtggaacatctatgccggctatcgtcatccttcgctacagtttatataactaccgggggttctctatggcaccagtttatagcctggtccgctctccaacacaagtctgcctcccctcttccagagccatggtacatatccgctgtcatatagataaagtatatgagctcgaagaaaagccacattttcttgtctggccagcattcccacacaacgagccaagaatatgattgcttggccatttgcttcccatatcgaagcctctggccagtccagctcctagagcactaaaaaaacctcttctccatttgaccagcccatccagattccttctcattcacccacacagtagttataatatccatcccgaccaggcgcgtttgcatggcccatctttgaaataccccgcattatcgaaagttcttcgggcatcacccatttattattaatcggtataaactttccacggccggaaaaccaagtgcggatggaagcccaatcggcctatctgcatacacgaggagcagctacccggaaccctgctgacatcgcttagtagtagtatagcacaggcggccatgaaatccccagttgatcccggagcactgccacagctccaatcgcgctgtatctggcatgaaaaatcgacgccattttgggaggggtagaattctgactttagattttaattttgttctgatgcgtttgcgtttgtctcaggatgtcacgcgcgaagccacggttttgtgtgaagtccgcgtgtcggggaaactaaatgattgagtgttaacctttttctctcgccaaggttttgggatatgtccatggctgttgcgatattatatcatcccattatggccgacagtaatctgccaccaaacctggtcaaaaaagtatttcgatactgctgagcaatttatagcgagcgccggacgacgggatagcctagtatattcggtgatggtggtggtgggtaggttttggtcaaggactgcacgaacaactggcagtctgcggtggaccggaagatggacctgtaagacttggccatgtagccagcggcaagtatcggtgtcaatgaacttatgacgagagaccgcgttggtacccaatcatggccaatcctttgttaacgggtgtacatgggacatcgaatatgtatctcataggtagaaaggtacatgggtacctaagtgcccaactgggagggtttcgggagggaaccaccagtcttcctactgccagtgtacattaaaaagagactctcgcttgtcccgcagaataattgacgttaaaatccttttttcttgaatgagataaagttatttcaggcgggagtgtctgtctggaagttccttgtcacagggttgatatgatttttctcttgtttcatctgccggctgcgctcagcactgggaatggcgacggacactctcccgctctctttttgacttcagcattagtgtgctgtttattacttgatactgacatgatgtcgattctctagtgtgcgacaattttgtgttctctaagccgtgggtactttgtctgtcatacttgttgtgcatgagacgcaaagaacgtatacctatcgaatcttacagagcgatacgcgagaatgtgggagcctgccctgttatcagcaggtaatcgagatggatgagtgattaaattatcacaaaggaatctgtttagtgagtgaattagagcaatctgtaatctcggggtttccgacaagtgtcatgaaatgcgaacgccagctcagagagaatcacgaaatacagcgtcttgggaggtggccatccatgtgacaagaaattggcgcactggatttaatctgaaaaacaaattgctatcaatttctggcctgcctaatggggtttccagaagagccggtggtgacagatcgtaacgcaggaatacgccccaaaaggaccgagactgcatagcctggtttgaatcaaggccacggtagccaattaacgaggtgcagtagcagcatccgtcacattgagaaattgccctattgaggagcgagagggcgtacggatgtcttattgggtgctcgcactcgacgaggtcttcctgcccattcctttgccccttgcaaaggccagggctaccgccgtttaacctggccattcgctgtgtgatgttatgacatcggtctgatgatagcaatgtgtaaggggccttttgagtgttcacaggtcgtgctctgaggcctccactgcatagatgagacaacttgggttggcgtaagattggtttcattcgagaacctgtaacaggtattcagtccacaggtagcgtcaactggcctaggcaagctccgtaagccacgtcttccacagcgtagccgctgatcttatggatgggacggcacagaacgtaaggtcaggggacgacagctatcgtaaagccccgcgctttgcgacggactttgatacttacgaccccgatgcaaccaaatcccatgaagaatctgctgctccttgcgtcccatcttcggttctttattcgattgatcagtcaccggttaatgctgagaatgcttttatacctcggataacaaccgagcaagcggtatcatgagatctgcacatgactgtttcagtgaatatgtatcccatggaggtgaatgacgttcacagactttcttgtgagagcatgtcgcaggacgtttcaataagggtgtaaatgcccttgagctgttggcggagcacaggtatgccccgtgatcatcatgacagcaatctttcagtaagagtcgataaccgtaccttgttggtgtttttttccccctcaagcaacccgtttgtattgccaaggatgaagtacgcttgcaaccctcccctgctgttgtatcagtaaagctgctctcccaaagtcagttatggcgcgtacgagataatgggggctccgaatgctaccctaggtctctcatgttccggatactcccccataccctaggaccaatgtggaagatgatcttaggccctaggatattgaggttcatgtacggatcagtaagcttgtagtagggattgaccaagtctatgtcacttgaaatcgttagctgtcacatcgagtgcatcaaaatgatttacatactgatagaaaatatctgactgaaaggtcatacatattcctggtgcgcttagtgcaacactaagctcacccgtatggggttgcaataggaatcctgtgggcaattcctgccacgaagaaaatcggtcgatatctttcttcaatgtgcccttgggctgcaagtcatccaaacacatgatttaaactagtagagcagaaagtcagaatatatcaaacaaacgagcgatacttactccataggagcatgatctcgaaaccaacgcttaccaggttggacgatatacacatcaaggtagccgcctatacgctgagagaggttaccttgtagcacatgaaattgatgagaagatatattgcttgaagcatgttcatcatacatgagacgtatgagttgccatgaaggtagccctatcagtcgacgggaagcaagcgagttcattcgttgatgaggatgtagatactagatagaggttccgatagaatggttagtgggaccttcacaaagcctcggcgcctgtaagtgccttaggcatcctactccatccctgtgaaatggtacttccacggaccgggctgccttccgatacaactacaactttacagaaagaccaaggaagaattaacgcaataaatacgtgattggcctttaagaaagcatagattaagctaaaacaacatctgtgagcgacagagataagaatatccttctagatcggattgccgacgcattcctgtaacattgcccatcaaaacgagcctggtggaggcgatagaaagaattttgaaatcatactgaaatgtcgacgaggagcggtgtggcggggaaaggctagttgactttgacgtcagatggctcgagcttcccccatgacagtcagtgctgagagagttcgaccgacccaaattacggacgttccatgtccatgccgtaatcgcgtttccgtcccatgtatgtttgaaccgtccgcatacgcgatgggctgtatctggacaaggccgatacttgccgccttccgtgcagtccattgaggtgagaaagcaggagaaatgaaacaaatctattgaagattcttgctgctatataacctgacattctggagaatttatcgcttcgacagaaaacataatcaaaggtctaccttgatgagatgatccaattgatgcaaggttattgagctgcccaaatgagttttgagactgacgagtctccatccgaagacccaagcggtcaagcttcaacacgtggagtggaacagatcgacacccaatctgctttgccatcgtgccggtcggtcttcaagaagggaacacattgttaatagtgaactactatatagatccgccttctaccttcgttttgtacttcctggcaaccttttggctgcaggatggataagaagtccgtatcttggaagacaaaaagactttcgtcatggctacgacacgtgcaaggcccttgattttagtagcgtctacaagactttcttgtgcaacatacaacttaagacttcagtaataatactgtggtaaattttatcgatctaatctactgtgacggtcaaatattaatcgcctgctttttctctcggtgatgcgtaaagttaagtagactcaatggcttagtccatcaatacaccgaatgagacatggatacctgttcaactttgacctgaaaaataaaaaataaaaagaaaaagaaaagaaataaatcaggcggcccaatccgcagtattcaatctgcggtaggctactcatacatctgggtaagattacatcttcactgtgtaaatctaataacgctaatatttaatgagaggacgccgtaagtccatttgacttcgtgggataagcaagtcaggtaacttcggccggtgacgaacatggagtgctccatactaaagaattgatgacttccgaaatactacgaagagtgatagagtcgcttcattactttttccaatgtttgtactagttacaaccattgtagtaaatagcagaggtttaatagtatccaggaaatttacacgatgtagtgtatcaagtgatggatgtcggatgcgatcgatatagtaaatatatatcttagtactgtattgatgctttatttagtcccgttaaaagtaagtaagcagctcacactggtcgcaatctcgggaaatgaattgaacggcaaatattcttctgcaatcctaggagactggccgctgtgactttacccttcttcaattaatgcggagaaccaccaataattactgtgctgagcctaagacatcaatgtcgctcattccgcaccggctgatatttgctcgctatctacctgccacagggaaatggagagtcctagggagtcttacctagattggtcatataaccgaggctggccgtggcttcgattgactccgctgacgtttgggtgtatcaacgcgtacgtaagaaaagcaagaatcgagccgcgcttcctgcgtagaaacacaatgtgattccatggcgagaaactgcattgtgcattagtaaagtgtcagtctgtgtgatagcacggcgcttgttttcctttcctttctttttcttctgagtttgaacttcatctcaatctttctccaatcctacctgtctacttcattcagcccgttccctgtttttatgcttcgcgtcttgaggtggcatttgcgtttgttgcgcatcgagccgttttaccttattctttcattttctaaggcctagcacgaaatcctacgtaagaagaataatctctattactgcttttccatccggggtgggggcaacgcaagtaggggaaaaaaaaaaaaaaagtaagaaagaagaaatgatgaaagacagcgatgtgcaaatcgaagccagtagcataatccctctggttaatgtaaaaccatgattcgcaaaataaaccaaagaaaatccagctgaaccaatggcgggtggctggtcgagctgacccaaggtcatacaggttttgttcccgagggcgattcgccagatttgggttgcacatgatgaacatcacgaattcgggatggccggatgctttgcatagtagttataatgggcggttatcttagataagaaatgatatgcttttttattatttattttcatggcttattagatgtaattcaaggacacgggcgagaattgaggtgtggtatacgcgcgcacacacacaactctctcatcccagtgtcaatctccaccaaacgggctgagaaattggagaaagagagagagtgtgtgtgtgtgagagtgagagagagaagggggtgggggaagggaggttggttttgtgatagtgaagaaccgtgatcgagcaagctaggcccggcggcacggagggagagagagagagggagaggaagagcagagagagcgtgagcgtgagcgtgtggtgtgtcgtcgaccccaaagttttccgggcatccatccatctggtatttagaagaaggataccaaacgagacagatgataccatgaccatacaagacgggagtgcaatacacgccttacccttaagggcaaagagcgcagacgctaagtggagcgaaccctggggttgataccggacagtacccccccatccgcttcactctcgtgattgatcattttccttcctccctttctgtcattaccacggttgtggtcgaatcatcatctaaggtacgtttagccatatactaccacttactactactgctgctgccccttgctcaactttgtattttttcctcttctgtgattgcatactttaatttgacgcgcgcccaatcatttgtatcctctgctgtaccgaggccggatcttcactattcattggaagttctcactcaccctcttccccccgggctccatgttgttgcctgttcttccattgtttgtgtgcatctgctttctgctgtccaaacaactggtagctatgaccataagctacaaccctctccactgattctagtctatttttggtcttttacatttctttgagttctttgctttgttttccgaaccactccacttttttttatttttattcttattattttttgtttctgttatacataccccttctgtttatcatataccataaacaccccctccgtcatctgttttataatttcccattttgttttgccgcttcggtcgcggatcaacccgggccggactgacatcagcggcagcctaccgtgcggtgaaagaaacggacgttcctttgcttgtccgcctttctctcgttggcagagcttcgtcgcgttgccatcgccccgcgaatcatcacaggttccttccctcgtgactgaaagccctcgtcaaatcattacaacgagtcgctttcagtgtcgctctgcattggaggcttttctgccacctgcggagaataaccctgataaaggtaattaaccttttcaaaccacgaggcaaaagtccgcctgttgttgttcttggctccctctggccgcggcccgcaaaccgcgacagctgtgattccctactgcccaccctccctcctcccttctccccccccaaaagttatggctggcgttacccaccctcgaagcaaatcaaaccattagaattagtgtcgcatgtactttaagtactgcaggcaagaccctctgcgactcctcctatcatccctggtccctgtgagcttctgctatcgcttatgcattgttatgttttcttgtcgcgtttcagttgcaaccccgactccccgccccatgatggcccaatcaccacgcgtcaatccttgcctttgcccttctctgacagctatctaacaccatgacctgtcaataggcgcgcatccgatttctacggtcggagactgcagaatagctcttccatcacggttgtttgattccctgtttttaagtgccgcttttgcgcgcgcgcaaaactccgcctacccttgtttggggtcgcgagtgcgtcgcttttgaacaaggtatgttgccggctgcatcatgattccgcttgccaacgcatacatccttcagccctgaaaagactaaaccgccacgatgttttcccccctcctgcctcccccccaccaccaccttgacagttcctatccccccccctcctctctcctccaatcgtgacagcgcacaaatcaggagtcgaaactctcgggatggtgggaatgatagatgctaatagttttttgtagcccactgagccgtgcgagcccctctcaggcgtaccctgacgacagcgtcgagtggcattatagttcgagagcctgcggaccaggatatttccaaactcccgggcccagacggactaactcaccaggttgctctagcaccgcctcatacgaacgtggccaagcagcctgacgaatttaggagctgagcagcattacccaggtagcctgccagttgtcgtctccttatacttgcgtagtctttgtgtgtctgcgatagacttgagcgccattatcaagaagatcgcgctttgtctgacaacgcatcaagtgcgacatcttgtcgagagcatcctggttccctgcatcgaagcccaaccacgttacacttggaggcgaacgtaagatttccacaaaaagacgcagaacctccggaaaaagcgggttgaagcatttcggcaaacaagcgttcacctttgggcgaatttccttgacgccagaagttgatgagtgggtgtattggcaaaacaaaaacagaggtacgcgccctcggtgtaagcgcctttcctctgttcccatccaacccccacccgcaatccagtgaccgtttggcgctgcgctccatgctgacactatcaaccagagcctgcagactttcgcagttcactcgtcgaatcagtaaataaccgcctttcctttgtgcacgacggtgatatagtcaagtgcaactgtgttgttgacaacctatcatttctcattattttcgccacttcggtctcaaacgagtgaagctcctttggattggcccatctttggcagtattattggttctagcctcctggttcctgacagccagggtactccaatcacgactcgaatcggaagcctgacggtaatcaccgtcgcagctccatgatggaatacccgccgcagtatcaacagcctcacggccagcatccccacgcctcctctcacatcactgccccgtatcagacagctccccaaaatgctgggtcgacggtggggtcaatgacttctcccaccaacccccaagcgcacatgcaacaagctcacgcgacacatcaagcgtctcccattgttccctcacaatctcattatcagcctgctcaaaatgccccgggctctgtacatcagcaaatgaatttcccccagtcgtatggagttaccacggcgatgccacagacatatggtatctcccctacgcaggcagccgcaatggccaccgctgcagcatcgggtcaattttatcctctccatcaagactcgatggctggccagatggctccgggtccccgcggatcaccgcgcatggctggggtgcaggtcaagagtgaccgcaatcctcgttcaccaccccagattcccggccagatgccctcaatgggatcccaggtacagatgtcccagaacgcccagatgcagcaacgtcgcatgagccatgtcagtagtccacatgttcaaaatgcgcaaccacttatcaaccatgctggacggccttcggtgcccccatctatgccgccaccaccacagccgcctgttcagcaaagccagccttcgccggatatggtcgccggcgccgctgaggagtcacctttatacgtgaacgcgaagcaatttcatcgcatcttgaaacgacgagtggctcgccagaaactggaggaacagttgcggcttacttccaagggtcgcaagccatatctgcacgaatcgcgtcataaccatgccatgcgccgccctcgtggtcctggcgggcggttcttaacggctgacgaagtggctgctatggagaagaagcaagcatcggggtctacgaccgctggactcgaaggcgctgacgataatgcggtgaaaccacctggcgataacccgccatccgcacagaaacgaaaatcaagtgatgtcaacgatgacaccatcaattcgtctaaaaagacgaaaactagcgccaagccaagcaccagtgcggatgaaagcgagaatgaatctgctgagctgtccgacgaggatggttgagcgttgcctcgtcctagaaccgttttgcgaaaatgttgctcaccacaacagccctttatgatggatggatgtctggattttctttaacccccgtcttccttaacctttactccctgcagcgagcgatgcgcaactgccccatcttctctcgtacttattgacgctattcccacctccctctggtttcttcggaaacgtctcgtttcatccgtttgaaacttttatgtctgtttatattgttatgctggcacgaagtattattactattttccttattcttttcatctaacgatgttcagcctgttaggattgcatgtatgagatgattatgttttgttatttttttttttccatttctcgggatggtgcacgattctcgaacttatgaattgttacgttcgtcccactgtcgatgctgcatgacccggtttcttatttccaaaggtcgtggttctcacagctggcggcagcctttttatatgtcttgtcgtcaaagtctctgtcgacaggcaactcaatgtcattggcaactttggtgtactgtgttctttcttctcctgtccctgagtccaccgctttgatccgatccgttcttttgcgtcttgcttcgggccttggttggtattagattgaagcccatcgctggtaaaataaaaccccgaggtcgggtggcgcggcgacagagcttacatcccttggtggtggatgatgcacgcatgtcttggttccgtgtcgcggattgtcccaacacacttgaagttcagtgcagttagtccgaaagtcgtttctctctggccatgcgtttcgatttggagagttctcgactggagaattccacgacggacttcatcccgtggtttttcatggaacatttcgattgactgttggagccactggggtagtgcctgaatgtgacctgggatctttctgttgttgatgcgattgtgagactacatggggcgccactctctctgaaatttgcattggagagtggtctgacatgcgaggctgtgatagtctgaggctaccacggccgatgcttctttccctctgcctttctctgttgcccccttttgatgcctcgtttgatatattaccttgatcttcaacggatgattcccctactagtcgtgtacaaatatcaagacatacttggcgaactcgttactagtcgtgcttgccttgttctcgtggcttgacattagagcaggtccctgtggtgtgagtgctttgagtagaacagagttagcaggccgcgagtcttcactttgccccggatgaaaaagaggggagtgaaattggtatagtgaatcccgagtgcgatgatgctgacagaagttgcttttgtattcatcgtaaggcaggctgcgtaacgctgctcctcaacaccaatgctggttctatctttctatattccccggtcggatgtcaaatctatggctacgactgagcatcccgcgcctctattttgccaccagttgctagcagcgtatcgttaggactagaccgagaaatactccacttactccactttcaaggctccgagatatcaggtgagtgagaacacattataatattgcctgccataaatcttttcaggatgggggtttgtggatgagagacgaggcgtacacactgtttatctctccatctccataatctttgttggaagaagagcggcgacaagaaagggaacccgggggcgctatgcccggtcgggactaggtggcctcccttctccggcgctccagcctcacttcccaatcctgtgtctctccttcgctgctttcccttccctctcgctttctctccacctcttcccttcttcttctctctttcctctccctctccctctcccccccacaacacatccgtttatatatcatccgccttgcccggtgattattcccggtctattgcgattgtcgtctgtgtcgtctgatctgctcagctcggattggacctagtactccgtccgtcatcttcgcatctcgttggatctccaattctctcctcttaaggcttctcttgtaggtcgcctgccttaccattcatcctctctctcatcctctctcttctttctccattgtgttcagtcaattcatcgcagcgcctttgtctctcatcgtccccttacccctgctcaattatctcagtccaagctgcccctgtcatccatccaattcatttggatccgcgcctcacttgtgcttcatcccgtctcttcctcttttacttttaaaacctcatcttggactcctttcatcgtcgcgccattattggttcgcaccaccctccgtgctgaattgaactactactttctactgtctaccttgtgccctcctctctttttctcgtcctctcttggctctcgcgagcgcacttgcgttttcatcctctcagtttccgggttcgcccctgtcatcgctatccaaaatcatgccttgtctatctcttccgtggccggctcccggcaaccagcttcgtttgcatcttcttcttgcccaactcgccccttaaccctgcttcgtcaacgtccaacctaccaggcactcttgcacacgtgaaggacttgctctaatgttgatcatttcggatcttagcttacgccttctgtctttaccgtcctgggcgcgaccctcggccattgtctggaagccggctccgatttcctccgttacggcccctaagagcttcggtcgacgcgattttccatagtcttgtcccgatggactcatatgacaattacgggtcccccggcaggaccagagaaggtggtgacccctatgcttcaagggttccggtggattcataccgccgcaggtcgcctggtaagtgtttagctcctagactacccctccgggtgctcccggactcatggtcatggtcttaaattctaatcactggtacgtatgcagtgtctcaggatcgacgccgaggacgcggacgttctcgctcgcccgttatgatcgaccgctacgaaccttctgatcgccgtgcatcgcgagacgattactatgctgcctctcgggagcatgccggacgtgaccgtgaggaccgtcgacgtgcgccttcaccgaacgttgccaatatcgaccgctatgtccccggacaagattctgtcaagcgccctatccccaccaatccgctcccgaacccgttgactctggaattccaagtgggattcaactggtttgccgaatggtggcgagcggagcagtcgatcaaagaagaaaaggaacgcgccaagcacggcggtcggcgaccttctgatcgcgtcaaaggggagcgggaggctcgtgaagatcgagagagagagagagcacagatccaggcggcttacgattcgtataaggtgaatcttcaggcgaagatggcccgtgctttcgtccagcatcatcggaacgaggagtggttcagagagcgctatgttcctgaggtccgggatcctcttcgtcgtcaactgatggatttccgcatgggtgcctatcagcaatgggagagagacctcgagagtggtctctttgatgaattcacgcttgaaggcatctataagagtgagagcgatggtgcaggcggtgtgatcgaaaaggaagagggtgaaactaccgcggttggtgaaaccctgggtgttctggacttgctgccagcaagaggcggagatttgcgtgatgaagctttgtcccagtctgctctcttgatcaagaccctagcgcccaatgttagccgcgagaagattgaagagttctgtaaggaacacctgggagaagaagatggtgggttcaagtggcttagtctcagcgatcccaatccgtccaagaagtaccatcgaatgggatggatcatgcttcatcctgcgcctgacgttgaggttgtcgagaggggggacggaagggaggaagagggcgaggaaatggaacatgatcacgcggccaacggatcggtgacagtgactgctgccgagaaggcacttgaggctatcaacgacaaaacgatccatgatcccgttcacggcgactttgtctgccacgtgggtgttcatgtcccgccgtcgcaaccccgcaagaaggccttgtgggatcttttttcttcgccggagcgtatttcacgagacctggaactcgcaaggaggctggtgtcgaagctcgatgtcgagatgggaggaagtgctgatggattcgccaagatcgaagagcgagtagaggagttgcgcggcaagggctggcttcagccgcctgtcacgggtcctgttagtgtcaagaagagaaagcccgactacgatgccgacgacattgacgaaggggaggcagaagaaggcgaagaacaggaaggatgggaagatgacgaactcgatgatgaggagctcttggccaagaagaaaaagttggacctgatggttgaataccttcgcagggtctacaatttctgtttcttctgtgtctttgagagtgactctgtgcatgagcttgctcgaaaatgtcctggtggacatctccgtcggccacgggccggtcttaccacacagtcaaaggctgtggctcgagccagtgctctagggcagccgtttcctgtcaagaagaaggagcccagtgaagagggcgaggagcagcagcctgtgccggaggagaagcgcccacagcgtttcagttccaagaccgaacaacaacttcagcgtgcattcaactgggtcaagacattcgaagacaaacttttgcagattctcgagccagagaatgtcgatatcgggaagctgggaggcaagcctgttgaggacgccttggaggaggagctcggaaagtatatgaagcaggaggatgagtccaagtaccgttgcaaagtacctgaatgtaccaagctgtttaaggcggagcatttctggcgcaagcatgtcgagaagcgtcataccgagtggtttgagaacattcgcagtgatgtaagtgatccttcaatgtgttctgtggggacgaatactcataatagtacagctctctctggtcaatgcctacgttctcgaccctgctcgaattgctccttcgcggtccgacgctaatagtaacgggcatttccctcttaacactggtcagggccagactggcacaccacgtgggttcagcctagcgtccatgccgccttaccttgcaggcggcggaaatgttcctccaagcttccaaggtgtgccagcgtctggagtacccggattcatgggcgttaacaacccctcgtggagtggtaatggaatggtgtctgcagatggcccaggtttgcaccagccaggtgtcatgcgccgtggcggcggacgctataataaccgctcaggtccttatgatcgccgtggcaatcggcatggcgctccaggcactggaagcggccgcctaagccccgttcgtggcatgtccagcatgtatggatctggtggtcgcctgccggccagttctggagcgccgtacatccctcctggacaccctgccgccgccttggtgggggccagcggctttgttgacgccggtgccggccagcaaggcatgggtccgcgcgaagccgtacaaggtcgcagcctcaagagctacgaggatctcgatgcggtcggtggctccggcagcggggagctgaactattagacaaattttctccgtgcaaatggcgttcgctggtctgtcgttcctgcatcttcacaaagccagttacatatttgatgtcccaccgcatatgccgtgcattgatccgtgtcttgtcatacttttattttctctattcctacatgagccgaaattgtctccattcaatttccgatttcctaggttcttccttctcatttccccgttgctctcaacgcttcttgtctatccaaacgtgaaacatcattcaggttgggattgtgcctgatttcctttttctacggaatatggcgtgtttccttgtgccctcttgaggccacgagttggctttgcgactgctactgaactatttccgggatcttgaaactcaagtctgcatgctatcttctctcgttcacatccttcgtcgttgttcttgtttttttttttccttcttcttctggtcttggcgtccctcggattgtaccatagtatctatcttatctatcagctcgatatcttcgtaccataagctcaatgacatatggccagatacaattgccttgctttgtccttcccgctgtattggactgacgcatcctaccttcagtatgaggaacgggcttccattcacactcgcaaaagtagtatttcaaaatgaaatcacagactaggatataccatccctgacacttatagtagtatgtataaaagaagtatgtacatatatagcgcatcgctgatgctccacgagtatcatatactacgaaaagaacccccaaagagatttggggggagataggaggtgggtatcagcccatccacccatcactacggcatctgaataacaacttcatctgcactatcgcgccattgcagccccattctgcggacgcgacgctcactcgctaggaataagagtaggtatatatgagaagctatctcaccccatgcatagaccttcaggattactggtctcgttgttgtctcatcaccaccatcctcgaggccatttgcaggtttatctgagccattatcctccagaaggcaccagacaccccagccggcgcggccttctttggcgatgaaatccgttagaaaggtccagaagcgcatgaagaatggcatctcccaggtggagctggaggttgagtttggatttggggagagattgaggcggaggtaccagtgtcctctctcgaggttgtcgaggggtcgggtttggttgatgggcgtgtatgtgcgggagggattgaggcggatggagagcatttttagggtgggggtgatgtgggttgtgaaggggtttgctgagatggggggtgggtttggcttgatgtctagggggaggtgtagggtgttgtcttctgaggttctaatgacttcttctttggtggcggtgttatttggcgatttgtcgttgttgagacgctcgtctgaggggggtgtattgttgcgtgcttgttgggtcaccagtggagggacatccacacgacttcgcttcgtatgaggaggcgagccatttgtatcagtcgatttgcgacgagatgtacttgattggggaagagcaatctcctgcaagtcgactggctcaaggggtattcgctcaggctgagaatctggaatgacactcaggggggtttcgagcgagtctttgtcatgatgactttgtcgctgaactgatgaggctgctccagggtctggaggcctgggtgtagaagagctggcattgtgtggtccctgggtataggagggaccggcttccgttgcagtggagacggggtcgctgtcgtctgatcgcaaggttatgacctgacgcgagaagggctggaaaccgaggatggcttcgacttgagcgcggtagctggcatcatcgcccacggtgctgggtgcggagatgtggacgagcacttcggattgttgcatggcatcggaggggaggttgataaaaagcctggaccgacatggtggggcactttggcttccgatgcaggcgtttgaggttaggcgtgacagactgccgtttgcccttggaagtagagagtacagacttgtagcctactagaggatagagtgaaagagaaccataacggcaagaggggggggaaagttgcagaggaaagagcatatgataggcggaagacgtcgaagatcacgagtcatggcggcctgaggcgtgttcccgattgggtggactggcggccttaggctgccgatccgctcgatagtttccgcgccgtccaacaacttctcctcttcactgagctcagacgggtctctgctcgacctcgccctcccttgagatcctccctaatctcgatctgacccggcttctcggggagcttcgtcggcgatgattcggtctttaatttcaattgggcccgtggtctgttggtaagctaactacaagtatcttggtttgtgatcctgttgggtgatcgtcgtcgtgcgcctagcctcggctcatcattgaagaaggattgggacaataatcgtggacaatcgtactagtggccatgctgaagggtgccagggccacacttgggtgatgtgataataatggctattagagtctataccattgacgagctatctatctgtcgaaaccaaggtgttcgagccaccgtcaccgctacccacctggtatttgactctaattcgaacgtgttattcaatggccgggaatgtcttccagccttcaggaaaaagcccgtgcactacccaatgggtagcacggagtacgcttggtgttggttggagtgtgctctgtgcactatgggctcgcattgtgggagaacccctcggggacctggaaatcaatgttcacgaagcctgcagcagacaaagagggacacacacaaaaaaaagcaaagagaccccggaaaggggcgatcccggtcagttacatcacctcgatttgcagggcgcgcgcgtgtgtgcactatcccatctgtaggtcttatgcgagaataacgcggtagttgtgaggcacaataaagcaactccgactcttgatctacgagcgcaacctacggagtacttactacctgtccgggcaaagagcgacgaaacgtcgactgactggcacgatcacgatgggatcgagtggcatcttagtctcctcctctctcccccctccgccccccttacagtggaataacaaccgcggcaggagcaggaaggtgcatacatccaatcatccactaagctccggatgtaggtaccgcaccgagatagtgtccacttgaccacctcagaacccggcagctcgcgcatgcttatcctaatgacgcagcacagccggagcgttggggacagtagattttcctgtgcctgccactaatgaataataaacgtatagcgctattctggaccaggcgactagtccgaggcttctgtgtgggcagtggggctgatgggcccgttgaacacggactggtgaaccagacaggccccaaaaaaacgactgtgggttgcaaacgaagaaggttaagcccagagtaggatcataccttttcccccctccccccccaaaaccatgcaggacgtatctacgggagtactgtggatggtcagaaggtggagggagagcaaagaaaagcaaagaaaagaaaaaaagcaaaaagggacaggctcgacggtagatcaaccgaggataacctgtttttcccaacccatccgtccgggtcgcagcgaaattaagtcaagaatgttacacacggcgcctgcctctattctgagatgtcaattgagggatggcaaaggtggaaagaagggcaggactttgggggggtcagagtcggcggaggctggacggtccactactgggcgacaggcgacaggtaagaatggtttctggtacgacagccggggggacgatcgatcgaaccgccgggccaaagagatgcgccatatatcagattcgtggactctcttttttcttgttcccctttttaaatcactccatttttgacatgcgtctttctgatcctctcggtgcaggatgaggttaggaccgaggtagagggggaagaagaatgaagaaagcgaataaaaaaaaaaaaaaaaaaagcacttacagaagcagctgatcgatgtggctagcaaaaagacgaaccattgccgcggagtgagtgatgatgacgatgatgaagagtactgcgtagtagcacgattgattattgacgatgcagcgaggatcccaattcgcattggttacagggagaggggtggcagcagagacaggcggacgtgaggggcgacgacgattcagacgaggatgaaaaagaaaagaaaaaaaaaaaaaaaaaaccaatagccaataaccgccgagtgactggatgcctggccgatcacacccggttgctgctgctgcttcactccacacgggcagatgcttttcttttctaactctgggttcggtgacatgaatacgaataattgaatcgatcacttgtgaaatagatatctgggggtgaatgcatgtgcccttgctcatataatgtttttgtgtgatggagagagggagagtaaggttgaattggttgtgtagcccatccagtactacttgagcagtactactgaatactactaatactcaatactaaagccgaggcgagatcgggacagacagaaacagagaaaaaagagagaaaagaaaagaaaagagaagagaagaggggggggaagaagaacccacactagtctgaaacgggccggggaatgtgtagactgtaaggtacactcactcacttattctcttctctctctctctctctctctctctctctctctcggtctcttattgtttctctgacctctttttccctctgcactggttgctgtccgtctctcgttttggctgagcatttattattatcatgacaatgatgatgatgatgattattgttattattttattcattcgaccattccccttttcattttgaagtgtaaattctttttcattattttatttttttcagcaattaataatccttttcgatatttgatattattttttttttttttggttatcacatctattcatatttgatttgttttaatttatttttcttgcaaagtcacgatcaattccgtcactgaccaatccattcccttcgtcctgtacaattccaattaatctgtgcctggatctatcgtgactagtggacgcccgagtgcatggccggctaagtagatgctagtagactgtaactaacgccgagggtgcctggcctttgcgccgccgactctcttgtctctgctgggtccgtgaagaacggggtggaaaatagggaagggagatgcatcaacgagccaataatgctcggggccgctagaaggcttgacagggtctccccgtcgatataacgccggctcgcctacggagggccaacttaacttgggtcccgaacaagtcgatatcgtcgctctccattcaatccaaacgaactagactatcagtagtgggtgtccaccctcaactcacttattcactcactcactcactcacttgccacaagagtattattattattctctctcttgacttgcctgtctgtccctttctctttttccaactctctctctcctactctcttttctcttcctcttcctctctcccctctctctgtcacacacacactctctctctctccactcacccttacactatctatctatctatccatctactacttactcttaccctccctccccctttcagtctgcagctccaaatctcaagacataacaacatccatccgtcgactcccgcccacacccgccgcacccactttctctcctcctccaacagaggtactaccaagaaccagaaaaaaccaattcaattccactttcactatttatccacctccacccacggacagtagacggcaacccggcaaactttcaatcattcaatcaattaatcgttattattgcttgaccgttttaccaccccgccagcctatttcccatcggctccattcagatctctccttttcccctgttccgttccagagctgagctcgtgtggtggctccctccctccacctccccaaactcaggtctccatcggccgcgcacttcggggaaaacgtccgaccctgccggtgcgtatatcttgttccctaacggtgaagacgcttggacagaaaaaaaaggaatccacttggctaccgattcaagtccattttaaggctgacaacggtccagattgattgaatgactctcgcattcatttaatctgcggtctgttcctccctccaccgtccagtcccatcgaatcctctctctcttcgcttcccctcattcttcccgcctccgtcctccgcttcttcggtgcacctcccccgtcggccatctactactgatcgcgccggtcgcatttctctcaatcaccctctttttcaatcttcacagccatcatgacttccataaatggtggtccgatgtctgtggacctgagtgcggccaatcgccaaactatgacaccagaggccatgccaagtaagttcccggcttcctttgacctggaaccctcacattgctgcttgtatgcctgtggtgatacgatcgacgaccgttgtttatttcattcctttcctggggaacatgtgtgttggatacacagagcatcccggattggggaaaggctgcagtcggcaccgttcgctcgtaacctaccaatttcttggttctgtcatctgcactgcccgcatgttgtatgacgtgatgtgctgtacctacatgttctgttttgatcttgtgatatttcttcgcctgctgtggtcttgcgttgctttgcttcggagaggatcccgtcaactacccgctctgacccgctgcttgcaggccaacccaattctagaccgtcgacaatcggggccgactttttcaaattcttcagcggcacacagaaaaaggttactcgaggtttgtgctaccgtggtgttcgctcttgtccgtactcgttgtaacctggctccttctagatggtcaacccgccaaacgacgtggccccaagcccgacagcaaaccggcccttaccagacgacaggaattgaatcgccaggctcagaggtacgtggctctcccgtctctgcacttgtctcgtcaggaacagatgccaacgggctgtttagaacccatcgcgagcgcaaggaacaatatatacgggctttggaaacggaggtgtcgcggttacgagaggcatacacacaagagatctcggcggccaacttgacggtggttcagcaccgagatatggtgcagtcgctatcagacgaaaacgccattctgaaagacatcctgacggcccatggcatcaactacgagcccgaagtcgagcggcgcaaggctgaacgacccaccatcggctatcagtccagcccatttgccagcagtagtaccggatcacagcccaccggcgttgctccttccaatccctccacgaacaacatgtacaccacgccacctacgacagtctcggccagcttgagtccgatcaccactgggatcgagcaaattgatgtgtcgtcgagcgagatgtcaccaccgcaagggccgtatcaggccgctccgtgtgacgccctggcgacgctagaccagatagcgccagtgagccgggcgccgaggcagccatcgggcatcttcgaagaacttccccagctgcagattgactttattctgacgtacgcccgccacatcttcatctcacagaggatggtatgactgactgctgtctagattggaatcgccgtgtcgggaacacaccgactatctctgccgccgatcgatcaccgaagccgatgacgaggacatgccattctcgggtcatgccttgatggcgacctgcccgccgcccagttacatcgcgaacacctcgaacgaacagacttatccgcacaagacctacgacctccctcatgccaacctgtcgacccttctcaacctcagtcggcagcttgtgacggatggacagatcacccccatcatggcgcttcagtgtctcaagaaccacgagctctaccgcagcctgaccaaggaggacgtcaaggtgatcatcgagacgctaaacaccaaagtgcgctgctacggctttggcgcggtggtggaagatttcgaactgatggactgcctcagcagtgtgctcggatctaaggtcgagggcgctctgtcacatccgggagatgagatgatgtattcgtgagctggtctggcggtagtgacctgatctggacggagtttcatggggtgattctttgggtttgggtatctgttctaacacggattttgatttggcgaggtgtatataaaagctctgggagcaaggctgttctttttcttctcacttctatcttccctttgaggattcttcctatggggttcaacgccagagcggtgctggccatacaacttgtttaatcttgaaggtgtcttctattctattctcctatctgttttgggatcttttcccacatgggttcagcgatgccacccaacctaatcaataatcacgagaaccacgaatgtccagctagcttagctaaatcgccataatacatacatacatacatacaaaccatatcctacaatcaaataagacatataataacaataacaataataataataatcaaacagtaatacccgtaacatcctcccccctccgaatcctccccaccacctccctcaccctctcccacgacccatctttcaaaatctgatacaccctctccaactcatccccttctcctaccccctctcccagaccatcatcatcatccccttctaaaaaaagaccatcgacatcaacttcacctctcccccctccctccatataatcctcatgctcctgttcatactcattcatctgctgccgcagccgattcacctccgcccgtaactcagcaatgatctccgcctgcgcaatcgcctgcctgtcctcgtccggaacagcgtacttgcattcatgtgcgatgtttcgcgcactgcaggtttcacatggttggagacggttgcactgcatttgattagatttggattgaaatgtaaaggatggggggcaaggtagtactttgacttttcgggtccggcaggggaggcaagatgccgtagggcgggatttggggcggtgggtgagagagggggtgggcattttttcctttttggtgaatatggaatgttgggtgtggtaggtgaagttattgatgcggtggtggttgatggtggatgaatgtggtagataagttagtaattagttaattaagaagtggctagcgggttggttagtgggtagtggaatgactaacctaaccttgtttggtttggtggggtttgttcctactttgtatgaatgaaatagggaggttgtctactgtggtattggatagtagattatattcgtttgattggtttatatatatatatgttggatttggaattgatagttactggtctttgaatatagagtgtgtggtatgtaagtggcttcgttttgattatgggatgttgtgctgaatgtgtcaaactctaccttatttctacttcttttgctgttacttttagtatagagttggaatgtgtgagaaggtatgtgggtggagccaaaaaatgtgtcatttaaataaaatgtatggatacagtgcttaaggtatcgagtactgtatttcacagcatactatctctacctccacagcagtatatacttctatttcatacaactaacttcctccaatcttaacctcaacactacccaacatcatcctcacagcagatttactttacaaccaaacaagaccctcccctggcaagaacacacctttcaatgccatacctaccccctggtattctctggcatttacaaattcctcccaaagaaccccacaatcctctcccacgggatcacctccacgcgatcatacaaatccacatgtcccgcccccctcacccacagcaactccttgggctcgctcgccccccgatacgcattctcactaaactccctcgaatgcgcgcgatccccggagataaacagcaccggtctcggggcaatcacatccaaatcctcgaacggataaaagttcatgaacttcaagttactcgtcaatgtcggatgagtcgtcaattccggggtcgacccgggcggcgtcacctcgccacgcaccgtgcggtagaaatcatagaattcgcgatccacggcactggcgttgggggtgaggacattcggcgtgccgccggtgtatgagatcggagtctcggagccgccaggctgctcgtactcgggccagcgctgcagcgcggcggacgcaatcacggcctgtctctgcgtgaggttctgcgagtgctgcaggccctgtcggttgacggtacccatgtcgtacatgctggccgtgacgatggctttgatgcgtgggtcgatcttggcggcgctgagggcgaagcctccgctggcgcagacgccgatgaccccgatccggtcgcggttgatcgtgatggggtgcgtgatggaggggatgctggtgatgctggtggtgttgctgcccaggaagtcgacggcggcgctgaaggcttcggtgtataggtcgggcgagacggcgttgcgcggggtgccggtgctgccgccccagaaggggaggtcgatggagagggtgatgtagccttgttcggccattttggtggcgtacaggttcgcgctttgctctttcacggcgcccatggggtggccgacaatgatggcgggcgcaggggtcgcggtgaggttgttggggacgaagaggttgcccgcaatgagggtttggtattgggttgggaaggtcaccggttggagggttaccaggttacttcggtagaagttgtcggcgcccagggagaggttttgcgccgtgatgcatattgcatgtaggattggggcgagggtgagcgccgttgggagttgcatggtgatgcagtggctttgtatgatttagtattgacgatgggattgatggttgagtgatgggagatcagacagatgagtacatggcttttatagccattgtctctgcgaacatcgtgatggctcgttgcgtgatggtgatagttttcaggggcatatagtcatgtctggccgagtcgagaagcagatcacttctggggtttcgtcatgcgcatgcaagttgcttactgtggggcgtaagctactctgcaacggtctgattactggttggttgtttgcctggagctcttgctactgggttaatgtccgattccatgcttacattgatccagggatacctcactgcttcccccactccgcaagcacataaaggcgtccctcgattgtccttctcttccgtcctccaagacaaacggacatctatccctttccatcatgccgccctacgtacacaccggtccagtggactgctcccaggatgcagactgcagcgccttgacaggcaaaaccgccatcgtcacaggcggtgccaacggccttggggaagcctatgtccgcgcactcgtcgcagccgggtatgcttcccacctcttacacttattcgcgactaatgcaagttcaaccacagtgtccgcgtctgtattggcgacatcgacacagagaaaggccagaaactcgaatctgagctaccagggtaagtcccttctttcccaatactaccgtcatcctaccctgactagccccaagcaccaaattcatcccctgctcaaccggcacctggaccgaccaagtccgtctatttgaagaagcagtcaccctctctccaaccaaccgcatccactacgtgatcgccaacgccggcatccaccgcgtagatgaaatcttccagccaggacccgaatccctccccgaaccagacctaagcatcgtcgacatcaacatcaaaggccctctctacacggccaaactagccatgcactacttcatccgccagaacgggaccacgcccaccccagagcaggaagatacatgcttgatcctcatcggctccggcgccggcttcctcgatgtgccacgctcaccgcagtactgtgccagtaaatgggcgatgcggggaatcatgcattccctgcgtcggacgacgtattactacgggtcccgagtaaacgtgattagtccgtggtatgtgcacaccggaattttgtctgaggaggcatttgcacatgttaagcgggccggggtggagtttgccacagcggaggatgcaggacgctgcttgctgaggatcttggcagatgggaaggttaatgggcattcgttctttgtgacggctcggaagtgggcggagaaggggtttatggatttggacttggaggattacggggatgatgcattactgggggaggtgcaggagatgcagatgtgcagtgccccggtggaagccgggttgtttggttagatgttgtagtgtaatccggtagtttgtcggcaattattggacatgttattgaattagaatgaatatgggaccataattgaggccgaggtcggagatagcatcaacccagggttggtattcttccatggttaagggtctcccagctccatcgcatcccggacggtgattgatggattgccggatagcgggtctggcttggcgtaagcaagatgcattagtgccggatagcagtcaagtttattcttctgtatgtgtgtgtctcccacagcttcttcatccagaatctgtcttctagaatgacttggaacttcaggcaacatcattctctcaggctagcactgcccagtaaagtcccaatcgaccttggcacgcttggctgaatacacatccacgcaacacattcgtcttctctccctgctgtcgacatcatcctgatctgcatcaggacgctggttcgagtcggacgattacaaatgtcctttatgtggcagtgcattatgagctctagtggttgctgcttatggcggtggagtcctggcttacctttttatcggagatagcagcctcagcctctaccatctatcaattgcttcaggaagggtattctgttgcctagatatgatgtgtatacgctcattacgatgtatatgtctgtgtgtttactgggtagagctctcggctatggagtatatatacagatcatagaagaagcaaagcatcatgggcggctcaatatattcgatctgcatcgatgttcaaagttgacatgaggttcttctatgatgttctgtatgtggtgtgcacattcatcctgattcagaatgttttaggtatgacagataactggtcctactggtgagaaccatccttacattactaggccattcggttcgaaacccagccacagaatatgcagcccggctcgagcaggttgtgattcacccccagtcacgaaccacctcggtcaagggccaactagacattactataggggttcctggacatggcccggtgctgctgcagctggaacccaatcgggaaattttcgtccaggatacttatatcgagtacctgaacggcacaaaccctcaaccactcaatgcagaaagggaaagagtgtttcggggtgaggtcctggtaaattcttccagcaatgcatggcattcggcagggcgagcacgcatatatctcgttcaaggtgggacaagtccgctaattgagggagccttcactctgttcgatcagcaatatcacgtcaacctagtcacgcagaccaactcctcccatccgcacatggaaattagcgcgtctggggattctacaagtacactgtctcataatacagtctttccccgccaatccaccgaagacaacacttgctccaggccccggagggtcgctctgatcggactcgccacagattgctcctaccgtgccgcattctcctccacagatgagctccgccgaggactaatcagcatggtgaacaccgcctcagaggtctacgagcggacttggaacatctcgctcgccatccgtaacatcaccattagcgacgagtcatgccccgaaacacccccgcgggacaccgcatggaacgccgcctgctccagtgggaatttggactggcgactccaggaatttgccgcgtggcgacgctggcactacgaccccaatgcctactggactctgatgacgaattgtcccacagggaatgtggtgggcgtatcaatcgtgggagggctctgcacttcttactccggggcaaatgtagtggcacggacgtccaatcaatggcaggtttttgcgtacgtttactcggccaattatgccctaagatccatactaattttgccgtatggatacagtcacgaaaccggccacatgtttggcgcgacccatgactgcgactctcaaacctgctccacctctaatggagattgctgtcccctgtcttcgagcacctgcgatgccggcggacagtatatcatgaacccatcttccacatcctaccaaacgtccttctcgccctgtactgtcggacaagtctgctccttactccgctctggcagagtagagagcgactgccttgtgcacagcaacaataccgggcctaccatcagtgggccttctacacctgccggtgagtgtggtaatggcattgtcgaggatggtgaggagtgcgattgcggtgagaactgcgccgacaattcctgctgcgtcaactgccggtttgttgatggctcgcaatgtggcagtggcagtgaccgttgccgatctggacgctgcgaaggtagtgaggatcgccgcccattagggggatatgaaccgctggttattggtctggctgccggtataggtggggggttgcttcttggaattgtgattgccattgtttggcgttgctgttgtcggaggaggagagtggataaacaggccgaaataatatctggacctccttcttacgctagagaagtaaataatcatatataccgatagttgaacacctatatggattagcgagatttatattcttgagtctttatgctgctttgtaactacatggcaaatagttgatctcgaaccgatagttgccaccatcaccatttccgatccatgaatagaagacccaccgtcccaaattcggaccaagccttatctctgagtctcaagttccaaggcttcagcctagaattaacgttcagaccgaagaatcaccgtttccccgagtgggtcagctactggtagactagccgtgcataaataaacctgcagctccgccgtcagcaacttgcatccaccaataacccacaccatgtctcgacacgaaccatccacaatggatccgatagctccttcatcatcaaacactgtgactctccggccgatgcctcagctagagcatctctggacgcccgaagacgattggacgggggtcagcgatcgaacccaccgtcgccggctgcagaaccgcttgaatcaacgagcctatcgtatgtctgttcacaccaacgctgattatccatctgaccgtgccaactaggccgaaaacacaaagccgctacggggaattcctcatcctcatcctcatccccatcttcatccagcactcaaaccttaatcccgcattcctccactatccaccaccaccccacaacaccaacaccaacaccaccaacatcaacatcagacgaatttgacgatctccactgccacctcgccccccacaacttccaccaaatccggcatgccttcaccatcctcgccacgcaaagctacctcaccaattctccccgtctcgaacacctcctcagtctctcccgcctgaacgtccaccgcgccatcaacgacaatatccgtatcctgggcatgactcccgcctggatacggcccgatgatgcgctctccatattcaacaacaacaccatcatcaccaataacccttcccctcttccagacgtagatatatctacccttcccgaaagtctccgccccacagctctgcagcgcctcgtcccccaccacccctggctcgacttcttcccgttccccgaaatgcgggatcggttgattgtggcggcgacggcgggctacttggatgaggatgagctgtgtcgggatctcatggcgttttgggatacgaggaactccggggccacgttggtcgtgtggggggtgccgtgggatccttggaattgggaggttacggaggcgtttttggcgaagtggaggtgggtggttgtggggataggggggttgaggaggagtacgaattattggaggggtatgaggggggaaggggggttgagattttagcagatgttgtataaaagttgggttggaggtttctgaaggaggggtgtaggatactgttcattcgttatatagtgttcaaggttctgcatttgagcactggagtggttagttgttttagggttcttccagtcatgcctctagtcacctgtccacatgtgatcccacacttggacaatttgagcaccgtcagcttctccatctttgttcctcttgcatcaaacatcacctgaaacatgctgatctgtctggccagcttttgacctacacaatcttaaatggacatccctttatcatccctaacccctcaacagtaatggtggactgtttctttccacagcgccgttcgaatttgtcactacaggatgtcctgataggttccacttggcaccgggcctaaaagggctctattggctctttgaggtatcggagaatgttcttccctgcggactcatccttttgccggtgaagtctgtcaaagcgcacgattccgaattaaaccagtggttgcccaactcgtctacagtacttgtcaacctgactacgcctaagctgcgtgacgcaaggatcattgcagcagcactgttgacgctttgaggcgcgggcagatgctttgcggctgcgggtgttatggaagccgccgaagtatgctctggactatgacgatgtatacgaaaaggtcctggagctgctacatgaggaaatccaaccgcattcggttctgattcgaagtagggcctctggctatgcttaaaactgatggaataacctgtagaatacatcatgggggagccaatttgtgataattctgcttgcttaatgcttgctgctcaccatttagaatagggctagtctgactcaagagaacggatgtgccttatgtcgtcctcgccggctggcaaggtcactatgagaacgccgtccgcactgaatggctcagcaccggcgtctacgcaaataaactatctgcgccaggcgtggctgttgacgagctaagcgtgcgctgctcaaagtcatttgtaacccatcttaccagaccaagacagcagagctgtccaagctatatcacacgaaagaaacctggggaggagaagcagaaaagatcactgagctagttcaccatcctgaacggatggccctacctatccccaacgtcgatgactctggactccctaccagggaccacttccagaccataaaaaacgcatcaggggacacactagagacaatttcacaccctgaacttcccaaccacttgcacaacatcccagggtaagcaagtctcccacccaaccctacgttccacccccatctaacatcctcctccagcttcacctccctccaaccactcctcgaactcctcatcgtcaccctctccactaacacctccatcctcctccccatgatcggctactccctcctcctcatcccccacctccgcatccccatcctcctctacctcatctacatcaaatacctcagcaaagcacacaaatccccatcccccctccgctccaacctcctccacaaccaccccctctggaccctctacaccacctacttccccatccgcctctaccgcagccatcccctcccccggcaccgcaaatacctcttcggctaccacccgcacggcgtctccatccgcggcgccatcgccgccttcgcctccaacggcgccggcttctcctccctgttccccgacatcaccaacaacaccctcctcatctccgacaaaaccatgcgcgcccctttactccgcgaatacgccctcgctctgggcatcaacggcgtcagctacacttcctgcgtgaaccatctcgctcgcgccggccaggctatcaccatctgcatcggcggagcgagagaagctcgctatgcaaacccgaataccatggacttggtgctgaatgtccggaggggatttgtgcgtgtggcggcgcagacgggcgcggacctcgttccggtgatggcgttcggggagaatgagctgtttgatgttgggactgttgatgaggaggtggtgaaggggagggcttgggtggggtgggttctgcgtgcttggtatgcggtgacggggaagaaggttcggtgggttggcgggagatggggattgatcgttccgtatcggaggccggtgaatgtggtggtggggagggttatagctgtgagggaggggagaggggtagaggatgtcgatgatgatgatgggtatgtggaggagttgcatgggcgttatgtggaggagttgaggcggttgtggagggagtggagggatgtgtttggggtggagaagggggtgaggttgaagattgttggatagtttgtcttcttgaattgtgtattcagtcttttggaatgtggttggttacttagtgtctggtttacgtgagtatgataggtagaagtatcaacagaaaatctactaaaagctgcgtgcgtcgttgcaattgaattataaatcgtagaacataatggacatactctatgttggagacgtcgttcgtaactaactttaaaaagcaaggacaatcaatatgcacatgagatagaagatagaagaaaaatagcttctctttactcctcagcctcctcctcagcagcctcctgctcctcagcagcgacctcctcttcctcctcaaaggtagtagcagggacgctgtacagacgcagcacaggacggttggggtccttgataaggacgtacttggtgaccttgtcctcatcctcatcggcatcgagggcacggatgcggtcgacgatagtacgcacgataccccaaccgttgccgaggttcaggttcatctgggcagccagatcacggggcttgtagccgacaacaccgaggacgacgtgaccagcggccgagcgggggttagcacgagagacgaaacccagcttcatgccgtcagccttggcgaggatggcctgggtggtccagcgggcgagcttgacgctgttgttcttcatctcagtagcaacaacggcaccgcgctgggaccagagcttgctgcgccagtcgagggcaccgccggagccctgggccttgctgtcgaactcgttgagggccttgacgagcagctgctggtcctcgccgttgacggggttcttcatgatggcgtcgacttcggtacgaacgatcatgttgacgggctcgtcgtcgcgctccagggagagatcgaagcgacggtacttgtaggccttggaggcgaggggctcggtctcctcggcggcgttgtagaaggggttagggtgggccagggagaccttgctgtcctcggactcgacaacggtctgcagggcgaagttgtggttgatgaaggttgcttccatggccagggcgctgggggtgttgatggcatcctgcttgttggcggagtcggccagctcgaggggagcgtcggcggcgttctcgttaacggtgaccaggtccagggaggcgccttcgcgcttgtcgaagtagatcttgttgccctggtggacgatgacgatatcccaggagtagacactgcggggggcgcacatgagcatggacaggatgtccgaggtggcgaagatggtggcctcgttcttctcggccagttcctggatgacggggtcctgggtggtggtgacgttgtaggcggcacggtcgagggactggagacggcgctcggcgttcttgacgggcgccttgtcgtaggaccggtcgtagtggtagaggaaaccatacgagtcgacgtcctcaccctcgggggcctcgaggttcagcttggacagacggctgaagtcaacctcctccagcatgttccagtcggggcggacgttgaccgaaggctcacgggtgcgctggggcttgtcgtagtccttccagccgaagcgacggccacggttgccgcggccaccagaacggttgtcgtagtagcggtcaccaccctggccacggccagcgcccacgcgctggaagccggcacgaccaccgcgctgggcaccaccgcgctgggcgcggccacggaagacggtaccaccgccacggccgaaggtacgcttagcggagctgcgggtgttgtcgacaacggagaaggaagattcgtcttcggcgacctggacggcgaagaggctggaggaaccggcaccgtagacttgctggtctggagggaaacagttagttgcttggtcttggcttggctaggatatatttaggataaaggtatacctctgtagttgcggttgtaggcctggcgaccggcacggttagggtccttggactcggcagtccagtcagccatacgacccagcttgtcacccttggagaagggagcgtaggggacgccctgcagcatgttgtcgctggcggtagcggggccccaggtgtcttcggccggcagagcggcgacgatgtctgcgatagagatgggagccatgatgtctgatttggggatggccctcagaatataggaattacaagggataggaggaaaaaaaacccagaggggagagtctggggaagaagctggaggggaggatcgcagagggcggatattgaccgacttgggcttcactttcgactttgcactttttgtgtcgcgagtctgtggcgcaacccgtcttggcacgagccgcattgcaccgccacatttgcgataacagtcaggtgatctgcataatagttgtgctgtattcacatgcttgctgagtaagacaacaaggcattgtccgttatgcacgctatccacggtttatttggaattgccttttgtgttcttatcatcatccaaattcaagttatgcccgcttatctctcatgtaatcgaatgcatgacagcatacttgatagatcgacaatgggtttaattgctcagccaactagtggcttttccacatcccccagtccaactaaatctccgatctcatgtgaacttaattccatccagcgaacatgtcaagggatctgctatctgagcgcttggctctatacccaatgtggatttacgtaaaggatcgtctatcagttcctccagctgcaaggctgagagtagttgttcctgtgatccagctgagatcatggtacctgatcagggatgaggctcgatatggggtcctgcctgtccctgtccatgaacgatcctcggtttgctggccgggaaacaccgactgcattcactcgcggtactttagccacgaaccgcactttgaacctggggtatgcgatctaaatgcgacccaaatgcagtgcaacgctcactgcacattcggagatttcaattccaaatagttattctatagatcgttcccaatttttatccggctatcgcgcatgcctcttgtccttggatggctagggttgtgtctgactcgccacccgaatgagttctaatttggttcaactgataagacggcgttgcctgacaggcaggctttattcagctggccccagattccgaactattggattctaactctgtcccatgcaggtacggtcttccccagaattgggaatgatcgatcgacttctccatagagttcttcgcttgcagcggtacctgcaggagaccaaggtgccacagactatgactggggcgtcgttcatccggaaatccttcggcttacccttccatgctccagcttccggaaaccggatagtctctcgtctgcacagcaccgatctatcccgatgcgacttgcttttgaggtaatgtccatcggtactctcgaccgagtgtgactgaaggaactacctcgagataaccatcaggattttgattgggagtttccgtggaactatacaactcagactttcagctcaacaccatgatttggatttcgatccttagtaattggcctctgctcaaacctatataggacgcttgagtccctctgtaattcttccagcatcagacaaaagctgaatactacaatccaaagacattctcacacagcaccagcagcgctcattctcctgcatctttgcaattccatcatcatcatcatcaccaccacaatgcagttcaccaccgctctctccatcctggccattgccaccaccgccgttgcttcggccatccccgccgctcaggacagcactgcgtctcttgaggatcaggtgaagcaagtggccgctcagcgaggcacctctgatggcaccatcagtaccgtcacggaggcgcaatgcatccctcccatcttgtgctgtggctccctcactactcctcttgaccctcttgtcgaccctattcttctggacctgggcattgatgcttccaacattgttggctccatcggtcttctttgtatgttgccagattctttacttcctcaagactggataatgggttactaacgagaaatacaggcaaggactacgacgacagctgcacatcagctcctcagtgctgcactgagatcaacctcttggtaagtttcttcctacgaagatatgatgtcaggctaacgccagtgtagaacggtcttgtggctctcggatgctcttccctggagcagtaaatgattggagaccttagaagtctggggctagtctacatggaatgaggactgtactattatcctgtcggacctattgagtccgtctgttagcgatacttaatttaatagcatatatggactttcgttctcagctttcccatcaagtcttgcttgcagatgagtagtctagaggttacctcagggataaaaaggggagacatcattctgaccacatcgaccagtcaccaatgccatgccaatcaagcttaatccgttccatgttctatatcagacagtgacatggttgtcccttctctaggatgtaattccaacatatatagacagattgtttgtcaacatcatttccaagtatccgatcatataatctaacccatctatacacagccccctcacaaacaataagaactaaggatatcatctctcactcaccaacgcccctccaatccacttcccagttcaatccccaccaactccaaccctcaagaacaagaatagaacccctcaattactagtctccagcacctccgtcccttccacctccggcaaatactccctcctagccttacaataaaactccacctgaggcctccatttcctggccgcctccccatccatcgtgcccgacggcaccaccacaaacccttcagctcgactactagtcacatacaccggggatccacagacgcgacagaatcgtcgttgcaacgtacttccggtgtcgactttagtgtccgtgaagctctggatgagggactcgccagatttgatggtcaattgctagacatatgttagcttcagatgtttctcgagataagaagataaagagggagagagagaaggaagaactaactgattctttcataaagctgttggccataaagctggaccccgtaaactttcggcagttgtcgcagtggcacattactcgtttcatgggttcgccggtgacttcgtattggatgccgccgcagaggcagctgccggtgatgacttcgggggtggcgggggcggatgaggtggaggtggtgagatccatggttgtggcgaggggctagtattttaaatttggatgataggttggggtaggtttggatttgctaggctaggaattaaaataggtgctggggttcttgtccggggttatctagtaattatgtagagaaatggatggagaggggagagggttaactagccatcccatagtagctgacaaataggctcactagcaacctggctgattaatgctgactgtgttcctgcgcttctgtttccgctattatggggaatgaaccgaaaagatagtaagatttctacgtgagtcagtgtctttttgtgtcagatataactcatatgatagtcgatctatccatcctggccaatggctccagttaagcttagttgtgctgacgccaccagcaacctatcggtttccatcagcttcgataaagcgccggataagctgccttgatcatgtccgcgccctagcgtggttttagcatgcattcttcaccaaaaggaacttctaggttgaagtagtgactcaccttctccccgatcatatacacagcattctgaatccgacagtcaggaataagagggataatggatgcatccacgacccgaagattctgcacgccgtggacgcgaagctccgggtctaccacgccctgggcaatgtccttggacagtcgggccgtgccgcaggggtctatgacgtgaacatgagttagttgctgtgcgcgtccaagttgagtgattgattgagtagcttacggtatcccgtttgcgaccgctccaagatcattttgttcatggcttcatccgaatgccggggcataggccatgggtagtcttccccgagaatctctttcatcccatctccggtcatgaggatatcgtccacgaaacggacgccctcccgcaaggctaggatgtcaagttcattggagaagaagttcagattgatgtatggttgttggtgtggatcggccgagttgagcttcacttctccgtttctggacagcgggcggagaagatcgacaatgacggtcagccagtcgccttcgggaggaacggggaagtgccattggaaggcgtcggagaacatcggctgcaactcatcaatatcttctcgctaattaaagggtaagaaaggtgacttaccacaaaatcaatctcaaaatgcggctgcccctccggcccgaatggatccctaccatcattctgcgccttcgcctcgcgatactccttgtatcgctccagacgatcatcaatgcgtggcagacctaccatttccagtaacccactactaaagggccccttcttactagtgcgatacttctgcaaagcagcgctctgcgcaggaccggcacggagaagatgaccatcaagaccagtcccatccttcagccggaacacatgcgcaagaataggatgatcatgcaaattctggccaacatgctccgaatccacaaccgagtcaatgccatgacgagctaactcgtcctttgcaccaatcccggagagcatcagcagctttggtgtctcgaagacgccgcacgcgagtataatctcatacttagcagtgaaagtcaattcagtccgatcggcgccaattacagtgacacttgttgccttgacaccatcgaagttgactttcttcccgatcgcagaactcagaatcgtcacgttcggcttatcagtcaaatacgatgcactggtcgaccgcaccccgccgtagatgctgttgacacagtgcgtcaaaccctccatcttgccggagtagatgtcctcgcatgtcttctggcctttgctggtccatgcttcagtcagggcgtctcggaaggtgtgtagttctggcacgaggtccgcgtgggatacgtgcagaggaccgttgcggccgattctggatagctctgaggggtagaggttgtcgtcgtcgtggtaggtagcgggctagttcattcagcattatcctgtgctccactacttgttattcatgacttaccttattgaaatactcctcgcacccatcccaattccaggaaggacccccatattccgcccatgcatcgaaagtccccttactccctcgaatccaggtatagtagttcaaagagctactccccccgagtaccttgccccgggtgttaggcttctctacccgctcatagtacggcttgtttatcatggtagacttgtacgcccaatcatactggctgtcacgcagtccaaaggctgatgatggcgtggtgatctcagagatctcgcccgggttgctggcttctgtcagaacggcacagtgattggttggttagtcgactgcgtagaggacatacctaacgcctgcttcaatgaccaaaaccctcacgtcggggttctcggccagtcgaccggccacgacatttccagctgtgccgcctacttcttgtcagatggtagaccatataaggggaatagaaatagaaacagaccgccaacaacgacaaaatcgaagttatcttcaacgggaaccgtcattgtttaggagcagacgatcgagatatggatggtgatcgaactaattgaaatgattcctagtactcattatatgtaaaacattactaccagtcggtagtatttatgtagaccagatgctagaagttatgtcaacatctcggcatcaggatatgtcgacaatgacgtataccggctgctccaccagcgcgtaacccgcgcagacaatcttgtcacttcatgacttggtaagacatgtcgatcccgagttatttccggcttatctttcattcaaggtcactgtggggtgtgagtgcaccctgcttttcttaagagaatcgagagcatgactatggagtgggtggctgattgacccactcagctgcgggactaacggttgctgaagcttgtttttcctcgagccctgtggtgatccggcggggctaggtcggatggatcggatgctgaggggggatgtttctgtgaagcaggttgggggtctatttgtagaagtacttgtatcacggagtaccttggtggtgttgataattgtggttccgctaatcaccaattcaagcatagcttcaagtatgattagccctccatcagctgcatctacgatggttattggaatacatatctttaaacggccattttgttcgataagagtaccaatcaaatacctcgtcttaattaggtcactacataacaatcttcattcttggcgaaaccctgatggaggaccgagaattcgaggaggggaccggaaactccgtcgcatatgatccactacgccatacttcattgccatcgctaatgatgcaaaacacagccaagcgaagtatggcgctgccgcggggataaaaaaaccggtgataactgtaacgagcccgcagccgaaaaatgcacgtgcactattcttctcacctttccatgatctgtcgagatcggcagagtctgtattgaggttcccgacatcatatagtaccacttgccgtggcacagatacaatattgaaccacgcatagtaggcaccttcgtccgtgtgccctttgatgattagcttcccaattccatcatcgatagccattctttcagcaataacaaaggtccttttcgctgggactagcaagtggaataccacgttatctgcgttgaccggatctatttgtcgaagcgaccgacgattctgccacattagggaaaatacagcctcaaggttggaggccattccgccgaaggaggatgggaaggggcttttccgggcccgtctctcgaagacctcgttggcactggttgtccgattgtagacatagaaagcatgacggccaacggacgtttctccaccagcattctcaatctcattgtcgacaaatctatatatgaataacccgaagccttgggtctgccagctttgaacccttgcagtcgtctgatagctcagttcatctggcacatcctggagacgtagcccgatgatctgtaactccctcggttttgtctgtgtatcgagggctgtacttaccagagcacacgaagcaaagacggcagtaaattcaggcccagcgttgaatgaattactgaggattttgaacgtttgggctgaaccgccagtgaagctgcttattgttttgttaatggtctgttgtttttgctcattttgtacggtgaacttccaacgacgtacccaccaaacctgtgctcaatcaagttctctccacggagagagaaaccggtaccagctgccacgtttgtaggttccccagcggtcgctgcgaggttgcggagcatttgtatgattatctgatccgagatgtcattggggttatcctcgacgggctgggacgtgcacgtagggtgctgggaaatggcttcgaggatgcgctgggctatacgacttgcagaggcaacgaggctagtaactggcttgttgaagataataccaagtgcttttagtatgctaaacgatcctttcgccgtaggatccataagaggtttcaggtcgtggaaaagtcggacataggcttcatcacgagagatacctggatagcgctgctgtatgagacatcctagctctgtcaaactcaggatgtttgcagacatctggccaagagttcagtatgaggcgggtacgatgtcggtcatagaaggaattcagctgcggtaaactgagatggtcacataagcgagtcagaacgtggatatgtcgataaccgagggtagtaatacatgtaaattggaatataatattgctctggggatgtgtgccgatgtaaggatcaactcagcgatgtcgaagagatttgtatagagtgaaggggggtggggcgaagtattaatgttgcggcgcagcacctcccccagtgcttggattgaagacttccggcccaatcaacaaagggtgaatcaaaggtttgcgacagtagataaacatggttcatgacggcagcggtgagaagctctgcaggggaacagacgcagtagatcattgcgctggacacgtgaacgttagcaatggtcatcaacagcagagataatacgggtcttgggtgtaagaaaatcaacatgtaagcaagccaacctctactaagaggaactaaggctcaatagcggtatagattgctggcttgaagttcgaacggcagtatatcggatgcaaaatggcataacgcggtagtggtctgaggtgtggaatgaggaacacagccttgttgattagtctaatcacccctgcctcaaagactctttctgcatccttggttaacatatgtggcggtgctatctcatcgagtggatcattctataaggattacattccatagtcgtcacttcccttgttggttctcttcacttgtccgacagagtaggagactcatcacgtctatggctacttaagagtctcacagtctcaggaagtcacttggacctcgttaggttcgatttgtaggaggttcgggatagtgttggtaattgagctcattaagatggtgtggggagaaacgagatatgggtgtttaggttcccagcaaacaaggaaggagcagaaatattgtgggcctgaagttatccagaattgtacactatggctggtatcatagatgtccagataaaaaaaaaaagaaaagaaaaagatagactcttctacaccaatctgcagcagtctgatctatccgggactgaaacaaaaaagcacaaaaaatggagctgcggggaatcgaaccccggacctctcccatgctaagggaatattataccactaaaccacagccccatttgttgaaagctgtgtctactatttagtattacatttcaataatacccctagaccaatatgcacaagaccctgccctctcacaaatatacaacctgcactcacatcaatgtttctggtcaatcaatccaggaatacaccctcacccccttcccacccttcagccactcccacaaccctgtcctcctccacctgaataacatcctcaaatgcgtccccgtccccgtccctgtccccaccctcaccctcactatcaccactaccaccatcatcaaacaccgtgccattcccaagcccggtccgataaaccacctccccaatctccatcccactatccagattatgaaatcctcctcttccctcaacctcaatatcccacctcgcaggccccctcttggtatactcaacatttgtgcaattcggggtaccgaagcccatatttaggcatacgtctatttagatggagaatttggattatggtgtgtaatagaggactgagaatggggaaggagtgtggtgtttactgccaacatgagagttgtcgcagttgaatgctacacttactgctgatgagagggtgaataaggctagaaagcctaggaagagaaggagttgcttcatggtgctctggggtagtgctcaatggcttgtatagaggatttctgggaactggcggacttcatgttgtgggttttatactgctaatgcacgagtttaatagtcgtttatagctaaactattcatgagtagcttcaggggatcagtattttggtggtacagtgtccatttcggctgagatattgtagttggtttgaatggactgtggcacaagattaattcgaattgatctgctgagcattcggctgatttgagaataagacaagaggttgtgtggctgccgtgacaagcgcaggtttgtaaatgagagaaggagaactgtggggaagaagagggatgaaaagaagggaaatggtccaaaataggagccttacagcgagcatagcctcagtcttacaagggcctgataaggtagcttcctgtagtacttcgtgaaattgactagttatggagaatagtagagtttagcaaatagcatatcttatcatcggcgggaagtgtcacacacgttccagtattatgaaagagaaatataaagagaggaagggagagtaagcttgcagcacgatatctaagctatcattttatgccagctatcattccatgccctaattcccaattgaacttgcatgatgagggccctgcgtcgccgaaattcaaagtttgacaacatgacattagcgacgtcgatgtggaaaaaaaacttgtccatgggacattccttctcctcgacgcccgcgtacaccaacaagagtccttgttcttcccactcgcgagtggtgacaacgacaaaagccgtggggtaccaatgaatgtcgccttccgcaccaccatcatcacgcggagtgaattccttgtccagctccacatgagcccggacaacgtctcggaggctttcccctttgaagtcgtacacggtaggggtgcgaacaagcggcatcgcttcgtcagtcatctcctgcttccactcccggtttaaggcggtggtaagcttatccaagtcctcggaagacagtccgaccatggaatagagagcaaaagaggcatcgtcccagttggcattactgccttggtgaagttccgggcaggtcgaaggcagagtgagatcaaggtgagcatccatggctgggagcgattcttggctagagagatgtgagtccacggtgggatttgagcgttgtctggagtatgcggcttgcttgttgatggaacaagctgcgaggcgtagcagactttctaaagaagtggttatgtcctgcaggggaaagagggagggacggagatggtggatgaaatgaaatcgtacaaggaataaataggaggggaaaggggaggggacgggggtgatctttgtagcaaaagggcggttgatgccactctgacgcaggcaacatttatgccacctttccgaagtgaatgcccgagttacattgcacccgttcaatgtctcggaatgacggggtctgtactcaggacacactttgtctatcggagagtctctcttatcactgtcgtacagacctcgaagcagtatccagaccgtctgttcccgctcacggtatagagtatcaaatataacttgctgacttcgtacgttccatcacgtgtcaagtcggcgcaggcaaagtgagcaaggttttgactgcagtctcgcgtcgttgaggtttcacaaatttccaagtctggaagcaatggctgactgccacgtccgttgcgagccaccagctcaactaactccgctcacttgagaccagaatctacctcctgcataatgcccctgtcaatctggggtccctgaaatgctatccttcctagcccataccacaacatgatcacaaggccaaacagaccaattagcacgggagatgtataattcatcgactcggcttctaccggtaacccaaggggcaggcagacaaacactccaagtataacaatccacaagatgacaaaggcgttgcagagatagccgaggcagccgaggttcaaatatcgacgtggtagtgtgcgcactcttcctgaaatcaaaactattccctgaggtaccacgtaagttatgtggaggaagagaatcgcactattggtaataatgttgaaagcgcctgaggaaaccaagtatagcaggctatagatagcgacaaagccaaagctagcgaccgtggtacgaacagggaactttagcttgtcgtcaactttggcaaagtatcttgctgacggggagttaatctggtcgagtcaacttggaaccatcagtgtgttatacaggcgcttacatcgcgcgccaaagcccatgcaatcctgccgcaaatcacccattgggacgggattgaggctatattttggcggtcagctcaattggcgcatgtgaaggtgtccgcggacttaccagcatagacaatcaagagccacactgacagaaaggtagtaacgcctttgctcttggtgctgaacatagcagttaggattagtttatcaaagaggtcagctcaaatacatacgcctgatagatcagttccaagcttgggagttccgagttcacaaccgcttccatgtcggacatgcagaacaccagtgcaacagacaatggaagacaggtagcgagactcagaattacactcattgtcatggcctgaggaacacgcttctctggttgagggagctcttcgctaatgtgaatagctggggtatcatcggtcggtcagtaggcgacaaaagttattgtggctcacggatacagacataccagcatcgatcccagtcatagaatacatcgtattcatcacgcccagcatccacgcagtaccttcgttccagccagatctcccgtatccaggttgcagcagaaaagatgctggttgtttttcctggcacatacccagtgtgataatgataatgagggccatgcccgtaagggataggaagagagccgtctgagccgtccagttgactttactcggagccaagaatatcggtatcactagtgggttagctactccgagttgccatcttggacagtgatcctcacgtgtgagcagtgatatagcaagatatatcaggtatatgtgccattgggccgccatatactctgtgtgccaaaacttgactattcccccaacggaggccgtaaccatctggataccggaagatctgcaacgatcatcaggaccttgtcgatcggcggatctggggcagtgcaacccacgtcactatccaccatgctaagacagacatacatccgacaacgaatgcagaaaaccttttcgacttggtcggactgagcatgtagcaaaaataatactgacctccacttgactagtcctgtgagccatgcgatcataacaaggctcaagaacacaatagcagagagcataccggaaaggccgatgccagctcactaagtccgagaattacaatgatttgaacgacaaaggcgcagatagatccaaatatcactagtcgaggaccgccataagccaggatctggccaaagttgctctgcatacattgtacgcttcagaagatatcactggcgcattggcataaatgcttaccatgtaccctgcccaggagttcgtgatcgagaaagaaattccaagggttgaaagccaattgaactgtcgcggcattccatccccattaattccgggggtggccacatccgaatcgagaatgccgatttcgccatcttggatgctctcgaggctcacgatggtaccttttcgatccaaatccgctgtcatattcgttgtttagggctgtcaaagcctaacaaccacgtcgagccctacactgacaactaagtttttccaagagcaccatttaaccttgtgaaattggcatcggatccttaagaactgttgtatgtctacaaggtgaagcaaggggtccgttcaactgatcgtgctcaccgtacccttgcttccaaagaatgggtctggactgctttatctacaaaagaggcgttatctgccgcttcttgtacgacttgactcgcgtggagggtgataatttacattgttctgatagatttgggttcatgacagccagcatcccctctgacatctgagggcgaagacagcgaatgtgtgaaactggcaaacagcgccttgctttaggggcgaagtacaccgatttcatagccaagccatgccaaattccctgggcaagcagccaaggcttttttagtcgtcttttctcgtctcctaccggctcctccggcccagcagctctcagaacccagattttgacttcctaagcaggcaaccttacatccttctgcaggtgtatcagcgctctcattcttggtttctcacgaaccatcattccacccaatagaatccgcggcatattatttcctacgcgccgccaccctcacaacttgccgcggtggcacagggttccgcgggatgttattcctcatcccaaaggtgcgtacagttcttcgggatgcctacctcgacataaccattctatgtagcccacgaacacgaaagatatcaagctatgggacttctccttcagattgcctgtatttcaagacatcttcattcgtggtaaattcacctaggagcgtcagagccacccgtgctaggaaatggcacacccataaccatgtcgcgcgctaggcatccgccacaacgaaaccagcccagatcttgcgccacagggaaaaatgaatgggaaaagataggcccgtctagcccgacaagcatgtctcagttacgtatgcatatgcgccatctacaggattacttagatttggcaccaaggtctgctctttaattcaggttttcgactctttaggttcgtgaaatcaacgaagtgatctctgtgtggaaacttatatatgaagtatgagcatcgcgcgacagtattcgggatagcatagctctatttgcttaccgatgttttagatgtctctagctaatacaacaataataattctcatgataaacaagccattaactgagcccgaaaggtccatggtgccagtgacgatatccatagtttccgggctatagcttcgatccttttaacaacggggcaacaacaacaaccgtcggggagaacgcgatcctttaaaacagttactcgaggtggtagattaacgcagaagtatatgagatcacgcagttaacctactacagtggcctgacttacagtcagatgggtaggaagaagtctatcctttggcttttcactggaacaatcaatcactggtggagcaagtggccttcagcccacggtccctgcggctcagccctgcgtagctgcgtatcttggatgttcttagtcaggtgcaaaatccaggagcctaaactactagtaactaagtagctattaaatccttcccaggcatccatcagtatacatacaagtaggtaacacgtgcatagacttctgggtactgtccgagtattactatttatcccaagtgctgacaggcagcaacgtattctctcccttgctttatcagtctaaccttatctaccacattctattttgaagcaaacaacaaccttaccactgacgactaccaatcctgaaccaacaacaatgacctcaatatcgacatccaccctccccaccatcacccgctccaccctcataaacaccaccttcaccgacctcaccccctccgacaccatcacccgcagcgatctccgcgacgtaaccatcacctgctccggcagcagaacccccaccacgctcctccgctccgccctaacctcctgcaccgtcacgcactcctccacttcccgctccaacctaaaacacaccactctcactaacgccagtgtctcccgcaccgaagctacgcacgcttccttcggcatctacgcctactcgcaccggagcatcctctccaacgtgattctccgcgatcgctcctccgtcaagcgcagccacgtaaaagatgcttgtttgatgggcggtagttctctctggcggagtaatgtcaccaagtgcatgatcgcggatgagagtcgggtgcagcggtgcaagctggtcgattgtgatgtggtgtgttgtgtgctggtgaagacagattttgagggaatggtggttaggaatggggtttggaaggatggggtgttggtggggaaggtgagggagggggaggaggtggtggtgttgaagaagggggatattagggtaatgtttttccttcttttctctttattttattgtgttttgatttttgctgactgttgtccggcatgtaggaaatgaagatcccggtgaatgagaagaagttggatagcaaggataccaagtactggttggaggaagagagttcggagggggagggggagagggagatgtcgccgccgccggcgtatacggcgtaggaattgatgttggagagacccattatatggtgactgttttgagtacaggcgtatagtacttccctatgagctttactgggtatattctctgacatactattggaaccgaatttagggaaactggagtagaactatcgctccagacaatatgggtactatgggtgcaattggcgacataacatgaatggcttggacggacttcggattccataggccatgtcgcaatagtcagccattactactgaaaatttgttcagtaccatagctaattatgttggagggattagtacgttgtgggaagtagtgactttcgcttaacccctgcagggttgtgatgctccgctatacgggttttggttcacttccaaaagcgcttgacatcgcaggtgcgccagatcttgaccaagataccgttagataataggtggaggggctaaaaagtacccatcaatataagccggaaatatcgggagcgattccggtcaatctgtcgggactgttggaagagtatcccaagttgggtgtggaactaaagtttcagcatagagaagcttctttggtgaaattggcgacagtggatcaaatcatgtatggcgcgcaagccataatctccgagacattgagcgatttagatctgcttcgtagacgttacgtttgacttacttgggccctagtcacactgatccgtcaaggtgcatttcacaatcaagcctctccagaggccgtccagatactaagcttatcccatgtcttcacgagaaatcaggggagccgatgagcactccgtggaaatctcaaacagacccctacggcacacttcatttcgcaaaatgaatcattgtctagccggtcggctgctcgctaaaatagaatatagttgcatggctagcgcactgacggtcgcccatggcgtactagccgctgcattagtctttggccttagtgccaaaattttctttcttccgagtcaggatgttacacacacaacaaagacgctgctgtgcttgcagtcttgtgtgccgaacattgaagaacagaccgcgacgcagcaagtcgatacgagactgtaaaaaataaactcatatcctagcaaagtcaggacgatcacttgaggagacacgggagatcgttgcggcgtaccggttatgtatagcagcagttcaggagacggtggagaaaccagtgactgtggagtcggtaccaccgacttttgtaccttgatgatgtcggcagctgcaagcaccaacttcgggtagtgcatgtggcaggcagatttccaagggtgccagcatgatgctttttgcagctctgaccaagtatcaaggtgatgtatcaaacggtgaatatcactctggagtcattgtaattaggaatcattgggaaaaagtagacgagagatgaataggtagttgacagggagtaactactagtggagatgaatgatgataaggctggccgctaaaccccgccgcggccggatgggcgcctgaggccggcgcagcaactaacgccactttggtccggtcggccttccggcggactctgtctctctccactttgtcgctccaaagaaatgcgagtaactctgtcttcctcatccctccatgacttatttatcgcctggccttccgtttcctgtcctcttctctcctcctcttttccagcttgttcgcgtttcctcctagttttgcttggtatactgctcggcggaccttcgcatatgaacagctacaaccacgcctagactgggagtctgccgtcatccgtcccttttctcgtccattttcgcgccagtgagcgcaagacctcaactatcatgggtctctccaagacaaacaggatcttgatcctgttggcgattgatacggcatttttcttgttggaattgattgccggtttgtcttcatactgttataagctcccaggcgcctctaacgataattttccgcgcaggttattctgttcactcccttgccctggttgccgactcgtttcacatggtacgcttggcctcatccttctacccgaaagccctaggtagcataattctgacgagtatcggtacagctgaatgatgtattatcactgtgtgtgggactctgggctgtcaaggtcgccaaccgcgaaaccaactcgaaaatgtacacttacggggtaagcttgactcactcccacatatccactgctcatcctgacggtctggttatctagtggcaacgcgcagaaactcttggtgccttagtcaatggcgtcttcctggtcgccctgtgtctatcgattttcctggaagctatacaaagactcgttgagcctcaggaagtcaaaaacccgaaattcgtctgcatcgtcggatgtctcggcttgttgtcaaacataattggccttgtgctgttccatgaccactcccacgggcacggccacagtcatggccctggagatctggaagaaggcgcagatgttgatcatgtgcacgctggggagcatgaccacgatcatgaccacgtgcacgcagatggccagaataacgttagtggaccagtatctatcaaatctatgaagctgacaacatgtggattaagcagactggtggtgccgagccacactctccctattcgcgtcgccgccggaccctcgatagtcaacgtcgtcgctacagtggatatgttgacccggcagacatccagattcaccccgctagtatgagacaggagattatcgcagccagtaaaacccgttatgatgatgaacaatccggctcggacagcgagttccaagagggcgccgatagccagccatctgagcgctcagccctccttggtcaaggcggtcgtactggtaaatataccgacgagacggagtcatctgcccgatcccggactgcggcagctgatgaggatctccacaaattccacaaccatgctcaaccaaagcccaaagacgaaaagcatggccatggccatggtcacgatctcaatatgcggggcgttttccttcatgtgatgggcgatgcactgggcaacatcggcgtcatcgcttctgctcttatcatctggttgaccgattattcttggagattctacgtggatcctgggatttcgcttgttatcactgtgatcattctgctctccgccattcccctatgcaaggctgcgtcccgaattctcttgcaggcagcgccccacggcctgagcatcgaccatatcaaggaggacatcgaaggacttccaggcgtcatcggctcccaccacctgcacgtatggcagctgagcgacaccaagttagtcgcctctatccatatccaagtggacacggagatcaagggcgaaggctcagaacgctatatgcgtctggccaggcaagtgaggaagtgcttgcacgcttatggaatccattcgtcgacgatccagccggagtttgcgcctgacagtgacactgaggacacaattgcggccccctcggactgccgtggcggcagcaacggagcctccgcctcggggacgcttcccagtcgagcacccagtgtacctgatggtgatccgcaggcgtgcctcctggaatgtggcgaggagtgtgccaggggtggccagtgttgccccaagcaatcgccgtgaggtgattcgataccaattctacctcccctatgattcttttattcttacaccctccttacaacctcaccatattaattttccttttctgttcaacatacccccttttcatattactggtacctatgtgactggactggccgttgttgatgttgcgtccgagacaaacttggtgcatgttgggtgaacttctccgatggctgcatgtgatgagacttgtcactggcaagtgtaattacattctttaaaacaagacgttcttattcttcttatgtattcttagcaatatcattgcatgtgatctggctctatcttctgcagtagtacgatccccctgaattatggaccggagtggagtgtgtggagtgcgttggcagtgccatggctgccaagggttcccaaggccctgaatctcgcggcctggggccaaaacgggggagaatgtctcaaaaagagtcgcgcccggccgccgcacacgtgacgtgtctccatccgtcaatcggcggcgatcccccttgttggaccatccattcccacatcgtcatgcactgactctgattccctcattcttatatctaatttctagctggcctgtcgctcgtttattgtgtttctcttgcaattgttgatgctcctcaaagcatgacctccggttcggtcaactgctagctgcccacctcccgcgtgtcagcctcggtaccgcaatgcagcagagctgcgctcgcccatccataagctgaaacaacgaagatgagctattcctactcgcacagcgccgttgccgactcttatcgtcctgctcgacgaggctctcccgcgtggtcctcgggctcgtcggagcgggatccatcaccaccgccatggccgaaacggtgggcttcgaatgtacgtgaggcgacaagtagtagacatgggttatggtcgctattcaagcggattgcgagatatgtcttcacggtctcgaacgctttgattgctctatggatctgcacactatggtggggcgaacggactgtctttcgagacagcgtgaaggcatgcaattggggtaattgggagagatgggtaggtgatccatgttgcaattcatccctttctttctttctttcttccgctaacttctcatgctcgctcgatacagccccaggacgcaattccacatcatgtcgccttcgtcgccgacccacaattagtcgaccctcacacctatcccggccggccatggcctctttcgacgttgaccgtcaaattcaccgatcaataccttcggagatccttctcatccattcagaaagaactaggtccagattctgttttgtttctgggtgaccttttcgacggaggcagggaatgggctacggcatccagttccagcccggagaaacgctacaagaaatacaaggaccgattctggaagaaagagttccatcgattcgtgaaaatattcgtggatacatggaaagatggtgatgagcatgtacgtcacccgctcgggcggaggttgatcactagcttgcctggaaatcacgacctgggctttggttcgggtgtccagatcccggtgcgcgatcggttccagagcttctttggcaagagcaatcgcgttgatgtcattgggaaccatacgtttgtctctgtcgacactgtgtcgctgagtgccatggaccagccggacccggagacaggcagctcgggcatgggctcgggcgatggagaacagccaaatgaacacatctggagagatacccaggactttcttgaccgcatgaacgtgcatcgcggcagggcggaagttgaggcgttgcgcatgcttgccaataagactgagggccgtcagtttcagcatcgggctgttgatatcttggaaccgtccgtggacccgcagcttaagccagaggttgcggggtttcccacgatccttctttctcacgttccgctgtatcgccgaccggccacgccgtgcgggccctatcgcgaacactatccgcctagtagcgagggcttggaggaggatgaccggaacgccattccgatgggtcggggctatcaatatcagaatgtcttgaccccaaccatttctcgagacatcgtctcgaagattgggcctaatttggtccagatgtattccggtgatgaccacgattactgcgagatctcccatcacgagttcagcggctctcccaaggagatcacggtgaagagcctctcatgggctatggggatccggcaaccgggctttgtactcaccagcttgtggaatcctcttgatctcgccactggtgaatccgatggcaccgctaatgccggccggacggtccagaaccacctgtgtcttctcccggatcaattatccgtcttcatctattacggggttatccttggtttcaccctctgcgtcctccttgtacgcgctgcgatcattgtaaagtatctcccatccaagacgagtcccgacgagcccattctgcccttgtcggaacatcgctccccgcccccgcagcgcgcggcccgctacaagacccgatcttctggtacgtctagctccacgttcccgtcgccgcgcgggctggccagccgtgcggtgaacgcacctcccttgtccgctacttacgcgagctcagatgaggacgaagtgggcagcgccaagtggaggccagcgcgtggcgggccacggcggccaggggcaagtgcctcccaagtcaccctggttaaagaggaattccttgcatcggtcatgggagtggccaaattcgctttatgttggtacttcttcctcgtctggcgatggtaagcgatagtgtttttcggttctggtgcgtgggtaaatattgtctgtacatagatatttggggcttccatcttgtaactttgggcaggcgtgcatgggtgaatggcgtcttctgatggtggggggcgaaaaaaaaaaatgacgaatatattataggtactagatacatgtacaatggtactggggtgactggtagtagttcctatcccgctttgttaactagtagtaactgtacattggtggttctgaagatgttgtctggtcaagtagttgtccgtagggtagtaactacaactctagtattatatatatattagtactctaaatcccactagcagtatatgatgcactactcatataccacgtcgcctgtaatacccgattgggtagggatcagttcggttaagacaaaaagcacgttgacataaattctcacattcaccaatcgttgaatcgatgagtgtcttaaaaccatcaaaagttggaaggaatgtggacctgcattgacagacacacaccgagaaggattgcttccggcatggcacctcttagctggattgtataagcattaatggggtataatattccatcacatccgatatggtgtaacggctaacatcgccgcctttcaaaccgaaagacttgaccgcggcagctcggggttcgattccccgtatcggagatgttcatttcttttttgtcattttttttttctttcccgctaatttatctttctttgtcttttcttcatcttagttttgtccacccagtcccacacaggagaaagaacatcgtgggttggctatctgcaagtaatacgaatgcatgatgatgatgtctatgtccatgggtgatagacatgcactgaaccttccatcaacatcgacggtcgatcccttccctgccgggccaggtgaccaactctaaccagaatagactttgggaccagaccatcagcgtcgcaacctcccagcaatcaaaccatttctcgcttgcaattgctactcgactaggagcgggcatatctcggggattcatccctacagggccaatcacacgagcattaaaacactaaattaagcatcctggtggcgttcagctcaaacgaattcgctctcacaacccatgtaattgggatgaaaaagaacgcccagactctcttttgttgactgcccaagcctaaagcggctccggtgagaaaaaaggagtgaccctgaattcaattgttgactggggaggatggcaatccatggttgccacccacgagcaaagcgtggctgagcccgctgaatggccggagctttgctggaattttcggttcgggtacccagcaaccccggactcacaggaccaacacactgacaccagggacggaatcacctcagggtctgctcaatcggtgtgtcaaggaaccgtgtatatttcctattgtgagctaggagatttagatccccagccggaaatagagacgggcaagacaagtgggagatctggcccgccggccacgcgagtctggctggccgttcccggcctcttttcccactcttctgtctgcaccagcccgcgtctggcctcatctccgcgcctcttctctctagatctctctggatctctctggatccaaaacagcccgcttccaaatcactggccgcgatagctcgcgtgtgttatcccgattctcatctgaccgaccatgatcgtggctgagaccggtctggggacccgtggatgatcgggatgatctcggccaaatgcctcaatttgacttttgtccgcgccgtcatagtcaatcctcggcacccccatgctctctctctctcagccagtctagtcgtctacagcttcatgttggcttggcttgtctcgaactcgggcactgagtggttccttcgtgtttatcccccactcatggcgccctcggcccaacgttcttctccagactcggtacgtacagtcgcagtgagactgcggagtctggggccccgttctcccacctcgcccgattccgtgtccagtggcgtgcagagaatgactgattccggccggtctggttgtcggtctgccgggtctggggacgaatctacctgctcgctgccatccccgcgtcccgctccaaatactacataaaggcctccatgtcccgggtctggggtagaatggatctctcatcatcttaccttctccggctccattgactctcacgcactgctacattgctcacctaatctacctaatctttgcctgactccacatcacctacctttagtcgattgctgtgcctctggtatcccaatcataccatgggtttcttgttgaagagaccggatgatgcggtgggctcagcggcccccgccatcatgatcggtctgtttgtctcctttggaggtatcctcttcgggtatgtacttcttttcctcagccatgatgcgttggatatggggtctgaccaggatctaaatagatatgacaccggaaccatcagtggtatcctggccatgaagttctggcggaagatgttctctaccggatacatcaaccccgccgatgactaccccgatgtaacctcatctcagtcttccatgattgtgtcattgctctctgccggtactttctttggagccctggcctctgctcctgttgcggattactttggtcgccgcattgccatgatcatcgaatcatttgtcttctgcttcggtgtgatcctccaaaccgccgccacctcgatcccgctgttcgtcgctgggcggttctttgctggctttggtgttggtctactctctgcaactagtaagtcgacaagaggtccccatttcacctaagacacgtgctaactgggacacagtccctctctaccagtctgagactgccccgaagtggattcgtggtaccattgtcggcgcctatcagctggccattactattggtctgctgctggcttctgttgtcaacaatgctaccaaggaccgcatggacactggctgctaccgcattccggttgccgtccagttcgcatgggccatcatcctcgttgtcggaatgagtgtgctccccgaaacgccacgcttcctgatcaagaaggatagacacgaggctgcggctaaggcgcttgcccgtcttcgtcggatgaatgttgacgaccaggccgtcgtggatgagttggtggaaatccgcgcctcccacgagtacgagatgagcgtgggcaaggcgagcttccgcgaaattgtgactggctccttgggtaagcggttggccaccggatgtgctgtgcaggcgctgcaacaactcgctggagtcaacttcatctgtaagtgtgcttcttttacttcttgacaaaggcccccgactaaccgctttcagtttactacggaacgacctttttccaacgctccggcatccagaacagctttaccatcacgctcattaccaacattgtcaacgtggtctccacgttcccgggtctgtacatggttgagaaatggggtcgccggcccttgctgctgttcggtgccgttggcatgtgcgtgtgccagctgatcgtagctattgtgggcatggtggcttcctcggacgtggccaataaggtcctgatcgcctttgtctgcatctacatcttcttctttgccagctcttggggccccgtcgcgtgggttgtgaccggtgaactgtaccccctcaaggctcgtgccaagtgtctctccatcacgacggccaccaactggctgctgaactgggccatcgcctatgccaccccctacatggtggattccggcccgggtaacgcgaacctgcaatccaaggtgttcttcatctggggcggcttctgcttcattgcgggagtgtttgtgtacacctgcatctacgagaccaaggggctcagtctggagcaggtggacgagctctattcgaaggtgtcgtcagcctggcgctctccaggattcatcccttcggcgcatttcgccggtgcggataccgaaaaggccgggccgagtgtgtacgaagtggagggtgaacttcctcagaagcgcgagtcgcagcacattgagaccgcttaacctggaatcttttttaatggcttgggatatgactttaattgtttggatatggctgaatatggtgtttctttctttttgtttatatagttagcctatgatgtgatgtatttagcgcacgatatgatatatacgactccgattgaatcatcgatctctctttcctgcgtgtcatttgcacgtcactggtgactcttgagtaaaggtgcctgagtgcctgggaggatgacaccgtgtgacgcctcaggcaacgatcgcccgtcgctgattgggcgccaccccccaccgggtgacgtgcacgggcccactacacgtgatgctggcctgaaatctggggccaatctttcatcattgggggaggctgcgattccagatcgtctctgcttcgcctcgatcatcatccccctatttctccctcccgactccctccttcccccctccctcgttcactgaaaatgaggcccttttcctttgctgcttttggatcagcgactgtaccctgatccctcatgttcatctccgacgtcgaccccgacgaggggctgtctaccagtgttgcccggggcgctgaatcgcgcgtttctgacaaggccccttactttgataccaccgttgaagtcggttccattgaacagcatccagcgcccgacgcagggctgaaagcgcccttacagacagggtatgagttgcaggatttgggccccgtttgtgatgaggaatcggaaaatgcctcagcggtcactgaacggttgctgggagaggaaggaccatttccggggaagaatcaactcggcacttcgattgcgaataacattacacacccattgttcccaccgctaccgtcctacggaccgccttccctgattacctcggttcaacatctgatcattcgctgtgtatccttcgtcttgtccctcgtctttctcggcacagtcatcctgggcgctcttatccagaccgctagtgcatctgtcttgcagattcgtcggacgataggcggacaggctccccacactacgagaatatatcacgaggaggagcggtcacggcaggtagagcgaaccaaggcatcgcggaggtggagttaccgacgagagaaggaggtggatgaggaggcactggatgagtgcccgcccttggaagggggcaaggatccgcttgtatgcgatgtagcatactacgctagacgggtagggctagatgtggagaccttcaaggtgcaaaccgaggatgggttcatcctcaccttgtggcatgtctacaacccgcaggagcacacccccttgcctcctaaggcccggcgcccacggggtccacacgtcttcagtggccagaccaaccccgaggcctctcgtcgagctccgggcaaataccctgtgctcctgatgcacgggctgctgcaaagcgccggggcattttgcgccaacgatgacgacagccttgcgttctttctgtgcaagtcaggctacgatgtttggctcggaaacaatcggtgcggcatggttccggaacacacgacgctgtttcagtcggatccacggatgtgggcgtggaacatccagcagatgggggtgctggacctaccggcactggtttcccgggtactcttcgagacaggctttgagaagctcggactcgttggccattcgcaaggcaccgcagagacatttatcgccctggccaaggaccagcgaccggagctgggggagcggatctcagtattctgcgccctggcgccggccgtgtacgcaggccccttggtggaacgggtctactttcgcttcatgcggattatcccccctctcgtcttccgggcattctttggcattcatgcgttcattcccttcatgatgacggtacaccgccggctacacccgcgcatctacggcacactgggatactatgtcttttccttcctgtttgggtggagcgatgcacgctgggaccgaggtctccgcgatcggatgtttcagtttgcgcccgtgtacgtgagcgcggagacgatgcggtggtggctggggggtgagtgctttgctcaccagaaatgtatcctcgcgacgagcaaggtcacgcaggccgaggcggcggaggatcagcgggtggcgcggggccatggcgaggttcgtagcaacaccgcgtggtatggcccccagatgcctcctgttgcgctgtggatcgcaggctcggatggtctcgtggacggacgccggttactgcaccgtctcgaaaatgggcgagagccgcacgtccagctggtgcacgccaaggtgatcgaggagtacgagcacctggatgtactttgggcgatggatgcgatcgaccaggtgggccaggaagtgcgacaagtgctttgggagacgatgccgcaagaggcacggacgcggtgccggatgccacggggcgtgtggactgcacgatgaaatgcgaaacacaatacttgatgactcgatgacatacaactgggactgggataaactagcatacacggataattcggctgggcgcatgtacatacatagcatataccatagacatgtagagtattggggggcgccttataattaccatcatttatgattcattcgatttattccttcatgcttaatggctctgaccccaacgcagatgatagcatcacctgcctgctgacttgtcgcttattccatgcagtacacagactcatcgccatccccagtagttggatgaatcgtccatcccatgaatcattagtatatccgactaacaccgacctcaccaatccgactcttgcatgccccgagcaggggcccccccagtcaccctcatctccaacggctgaactagttcgatgactagtaaggagttagtggctgcttagccttcccagtttccacccttcccccccccgccatattaatcaagccgcgtatattacccaccatccacctggtcctcatgcccctcccacaagtcccaaaaatgacagtttgcttagccctccgcactgattcagatcattggctccgagtatccggacgtgcagtagtcaagcactcctaagcagccagctgggtggcctaaggcctgtggggtgcacatgcatctcatttagtttagtttaccgagttccatcatgtatacttggtcactttggaatgtacgtatgtatcttctctcgtcctcaaggtaccttttccttccccctcgcttgtgcgagtcgcagacaacgcaggtactgctactgccgccgaaaccgggcttcttcatgtgttttgatcgtgaattgtggatcggaggacaaggggggtacgtcatattcctctcctcccctcttcagcggtgtcttgagccccaatttttcggatatcagatagattatggtgggtttaggagcggaaattgtaccagatgaagataaaataactcatagttaggaagggttaatcgggttgggtggacttttggggatggtatggccggcctggtgtctcaccatcgtctagctggtagggtagtagctggcttatcatatgtcttcagaacctacactacgaattttgtttaagggagttgaaatatacattgtaggccttgactattccggctgtgagagccggttccaatcgcctctataatgtatttggagggtaggtacaattccgcttcagcgatgcaaatcccacctttaaaggcaaccgggttatccgaggactggctttcgtatcgcttgggggtgcgaatgggtccgaggagttggagaagaggtgggcttggaaattggggtggcttatggggattcatactacatagggaagatttctagactccgaaattcgagtagagacgggatatggtgaatgggggttgttgcggacggcagagtcaaggcggaacgattgttacacaaaatcggggaataaccgtgggagaaaacggagagtgatctgaagaattctcgtgaatcaaggcgaaggcctagaattgctttttgtaaggctttggcgttgaagtaagggcgggtggcatgatgatagtaggactacgagtagtaatagcagttggaagtagaactgaacaatgagacaatcagtagtacggcgatatctacacctgaggattccaattagggctgtggagtactatatatagatggaagaagaggtgaagttgggcggaaaaaacggttgaatttgacttcatctttgcttttttgtgttactattctttgcacaaaactctcgtatgaacatacttttgcactgacagcctgtctgccgcgtccgagcgaataacagcagccccgtgttcctcactttcaacgcaaggtgtgctgcctggagaggaagcatgtacaccgacacttgtcgcatcgcatatcaatcagatacccagaaatctctcagcaacattccaaaccatcaccaccaccaccacaacccacacatatccctggaatttcatgcagccactgacttgtttagtgcggggcacagatgagggaaaaagttatgggttgaaagttgaaactaacgtgagattaattaatccattgattgaaaaatgacgatccggggggtccccaaaaaatacaacaccccaagaaaaatcccagcaatcggaaatcccagcatagcccaaaatcaaatccaccaagatggtgcaggccgcccacccaaaacaaggaatcccagacgccatcgacgtgtccttccatgcagcacggatgtactttgacaatcaagcattggaccaagaaattctccgcacgcggggcaccgccactgccatccattcccagcatcatcatcgttatggctgtgcgtcggtgaactaagcgatcaaacaaaagaaaaaactttgattctatggaaacttcctccatacctccatacgggccccgagtatctattctgcctatccagcatgattaaaaaaagaaccgtatacccacatcttcggcagttgaatgctgtcaccgaagtcattatctacccggaaaataagaataagtaaatcacaaaacaaaacaaaacccagcactcgcagaatatgcaactgcacaatgcaaaaaggcagccaaccacagactaaacccccatcgagtctcccatccctagcaaggtaccttcccctaacgcggagccactctcaacgctagcctgggcttcatttccagcccatccggcccgttcatcaatattggacagaaacaaacaccagcaccaccggatataccctcgtccaggttgctgccttcgcccttcttcttcgattgcttttttgcggttccaattcatccagccccgcatgtaattaccgttccccgtgccactttttgggtggtgcgtgccagctggcttctcttttggctactcaccatccctacggggcagcgattctcgtgacccgtgtagtagctccagtctctttcttgactcgtcttctccaattccagtcagcctgacactggattgactttatccagatcctctcggtgcatgaggggaaaaagctaaagcttgccgtcatggctcggctatgcgtgagggggcgtggacgaaacactacatctgattatccacaatccgcggagtggagcgtcggctgttcatctgcttgcttgcttgctttgactgctgtctgatgtctgctgtccgtctgtctgcacgccgatgggcatcgatcgatcagggcgaggagcccgcttccgtggccggccgtgtagccgtggcctctttgggctgttggccgagaccaaaaaagttataaagaccaggtccggtgccagattcttgtttcacaaccagagctcaattcatcaagcaaggagaccttccaagcaagcaattcagccagccaacaagcaagacaaagcgaagccgcaatcatcattcagcaaagacttcttccttccttgtcattcctaagttcatctcattatgaaaccatctactctctactcttctctaccctgggtcatcacgtccctcttcacggtagctgttcatggcgctcctacagggacaaagtcgaatcctcccctacgaggctccgagaatctgctgggctactcggcctccaacaccgtgacggaccagtccaccgatgatatcccctatgtcccggtgccaggacagacggattccgctgacctcggcgtatacctggactttgacgatgttgagaacccgcaaccggtccgtggaagcacgggaggaactgaccctggacctcgtatgtagcgtcgatccatggaaccagaccaggcgtttggttgatctgcgaatgatctcatctcacaccggaaaataggcaacgactactacgatcggatgaacagcgataagctggcccctccgggaacggacaatggccagacgatcaatgcccaatggcctatgggtgagtccaatttgccttgcctttttttttttttttcttttctttttctataatcgtttagcccctttatttgctttttcggcggaaaaagtttaatgagacagaacaatggctaacaatcgggtataggactaagccataatcggtaagccgacctgcccttgctgcaatgcatgatgtactatatactaactggagtgaaggctgggattgaatgagtctggatgggctcggcaagagaacgaggtggtgatgccgggcgcgaccgacatggctggagtggatatgcgcctagaagcaggtgcctatcgggagctgcattggcatgtggcatcggaatggtctctggtgttgaacggatcgtgtcggatcgaggtaagatgcagatagagagaaagtctgataaaccagtttgtgaaagctaattcttatcaaccaggccgttaatgaaaacggacaaactttcgtcgatgacgtgagtgccggcgatgtctggttcttccctccgtaagtttttcgctccaattccaaatcattgtccctttcatagggatgcatcgatgggatggttggctgacttactccttacagcggtgttccgcattccatccaagccctcgactcgggcgtcgagtttctcctcatcttcgacgacggttccttttccgaggataataccttcctcgccactgaagtgtttgcccatcaaccggtacccctcacttgctccacccaaagtatgtgtgatgattgactaacgatggctatagcgcgaagttctctctaaaaacttcgacctccccgtcgccgctttcgacgacatccccgaagatgaactctatatcttccctggcactccggcaccgcaaaacatctccgagcagaatgtaactggctctgcaggcgtcctgccgcagtctcaaagctactcgtatcacttttccgagcagcccgcacacgaagtgcaaggcggatccgtcaagatcgtcgactccctcaccttcccgatctcctccaacacggccgccgcgctggtgacagtgcacccaggtggcatgcgtgaaattcactggcacccgagcagcgatgaatggaccttcttcatcagcggcaaggcacgcgcgaccctgttcacggcgcccagcacggctacgacgttcgattaccgcccgggtgatgtaggatacttcccgcagagcaacagccattatatcgagaacacaggagatgaggatttggtgtttttggaagtgctgcagacggatgaattcaccggtaagccatcatttcacttttcttctgttttaaagagttgtaaatgtcagtactaattgtggtatgcagatatctcattgggccagtggatcggatccacgccgaagcagattgtcgcggatacgctgcacctgccgcagagtgcgctggatcggctgaagacggagaagatgtatgtggtggctggatcgaatgagacggatgttgctactactgattagtagtagttgctattgtgggatgtttgatgatcattatgatactgatgactggacatattgtaatgggacatatttttttgtcattttgttatgaggttaggttaggttctgcgatagatttagtttgttaactgatgtttattttgggtatgatcagataatctttgtcgtatcagatactggaatgtactagtaactagctagactaaatacatggcaccaatccgagttgtgctttgcctccacttctctccactcactcaatcctcattctttccccgcatgaccaccttatcatagtagtattaatttatagccgtggatacaaacatacccttcgatcaatctacactattgtttagactacgaacaaatccccaccccaacaaccattatcattataccctgataccgaaggatgctatatactaacctccctaataaccccctcatgcctcgcactcctcgcttccaccttcagccccgccaaaacaggatgactgaccactccaggcgtgaacctcacctcttctctctccccatcccccttctccaacgaaatcctcatggcactcaacaccatcccgaccgtcacaaaaacactcgcatccgccaacacccgtccgggacacactctcctcccgaacccaaacacccaaccagacggatccggctgggggttctcacccaggaaccgctcaggatcgaacttttccggatgtgggtagatattcggatcgtgggttattgccctgcagacacatcagcacacatcacgcttttctattccccttctgaaaagaaggaagtgagataagtataccagatattccccatcactatcgcccccttgggaatcctatacccatcatacacatcctcctctacacaaagatgcggtattcccatcggaccaaccgggtaccaccggagagattctttcacgacggcgttcacatagggtagtttatcccggtcagagagtttggggagagtgtgcgggcctaagactgtgtcgagttcggcttgggctttttcctgaatggcggggttcagggccatgctgaggatgaatgtgcggagggctgatactgtctataccatcttttagataattgctggggaacgtagaaatatacgaatggggatggggacggggatgagatggatatcttaccgtatcagcgccagctatatatagtgagcccgctgtccacttcgctgtgaattcttcttctgccgtgagggtcttttcctccttggtatcctcctcctggaggagattactcaagtaggacggaggtgctattccagatgccatctgctcccgcaccatcctgtacggcgtctcgatggtagtgaggagttgcgtacgccagaactggctttttcgttgagcagagaagggcaaccaggaggggaggtatttcactttccatgtatatcagtataatcccatttttttcgatgtgaagagaacaaaggcaccaaggacagaggaaagaggagaatcatacaaacaggcaccagatccaccaaccacacctgattcatcaccgccgaaaaagtctccatcgagtcatccgccaaatcgactaatttatccctcccgtgcgggttgatgtcgtacccgtagccgattttgaggatgatggcgccggcttccctatcatattatttcgtttagttcttcacagtaatgtcaaactccaaagtaatattttaataaaagaaggcttggagggaatatacgtcttcaaatgctgtacccactcccccggatcctctaacatacgacgcaataaccgtctcgcttcgagctcctgcagcgtattgaacttcgatacgagggcttttgttcccaggacttgatgcatggctttacggtatgcgcgaaatcgcgcattgtaaggctgcatgcccagagtgtctttccatccgatcctgtatcatctcatcttgttagggatggttgtggatagaagggtgataggtggggggaaaacttacatttctccgacgaaaactgtctgtgatcgggaagagtacttgagggagcgtttttcgaggagttcgatggctatttgggcatcgtgaagaataatgatgggttggttgaggatggtgacggaggttattgggcctgcggagggggattgattgttagggcttcttgatggttgtgatggtggaggtggctaccgtagcgctttttgtgttctagccagtgctgccattctggggtatctgggggtggcaggtcggataggttgccgatgatgggcttgcctttgggtccggggggaagggggagagaggcgatttggtgattgatgaggaggtagacaggtaggaggattaggcaggtgaacgcgaccgcagttaagatactcatggtggggtggatattgatgcgatgagaagttgcagggttgagattttggcatctggcttaaattctgacatggcgggacggattgcggctggatatatgcagctagtggttaggctggttgcggcgtcgagccagccgaggcatttgctggtgaggtggagtcattgtggatagttgatgcagctaatgatgagcaacaaggacaattggtgtagcgatgtgttagtgaacgcaggacgcgacacagcatattaagtgtgccaatggagctgattgttatctttggagttgcattccacattcctaggctggattctccggcctgatacgtggctctgctattttactgtcctacgctgatgcttggtgctgacctatcgtttaaaaggagccccatgcttatcgcatagctcgtgtcagaagcaacattatgcatggttgtggcattaggattgtgagtgaagatgtttagggaagacatcagcatgtcaggctattggatttgatcccccagcgtatatggaaaaggaatgcccttattcactcacataaaatgtctatataagctcgatcaagtcgataattgcaacttcttcctctccatctctttccactactcttatcctattccatatatctctgcgagatcttgatggctattttccttagggtcggcaatggtacatatatttatctgtccttgtctctgcagaagagaagaccaaggtcggggaatgaacaagcccgtctaggtctatacccacagcagtaaaaggttgcaaatacaatggtcggggtttctagtgacggcagcaccaccagatccaccgaggaagaagtcctagtgctgatcctcaacttctacatcaggtcatctttcgtgatacgtgttaaaagcataaaagcagatctcttctttgaaccatcgcttcgtcatatcaaaggctcaaactcaattatatccgtttctgagtacggctctggtcgaatgatactgatgagaatctacgcctaatgaaagtgacccaaatgctggaaacattaccttgtcggttattcatccacaccaggtcaaagatttccatggacgcagccaaagcccgggaccatgaccgctatgtcgtaacccagatgggaaaaccacacaagtttctcatatctacccgtactcactgggaaagcctgaaagcgcgcgcgacgaactctggacacagctcgatatcttctggctattaacagaattgacaaatggattaacagaattcttgggcccaaaggcgcagagatacctcagaacatctcgtgctttagaggtaccctggccggaaggactaattatccctgcatttaggtggtttatatgcgattgtctagcatcaatcccacttccctggagagaaactcgatcggagaagcctccatatatctggtgccaataatcaattcatggtaggcgcaggtgtagatgctgctgggaagagttactgatccttgactttttgcagtttccttcccacatcccaaggtcggcaccagatcttcttcaccttcgcaaagtacaagaaggggcagaagagtgaagccgatgatgattttctggtcatagaaatacttggcccgtatgatgctaagtattgtgattatctttatgatcttttcagtatcaccttgttgcaatattgactgcaacggatgcctgttaatccagctggctctaaaacagatcaagacataataagtagataaacatgcgactacttatctcgtgattcaattattgaaagggacgtcagctgtggtgtgtaaacaaaatgactgagtctatatagcctgtcgaatgggttgatttgtggacctaaatgacagatagttaaaggaaatctaatgtgctgcggcatagggaccaagtacaatgacatgttcctcactcttgagcactgaaagttgaaaaaccgcatcgatgactactacagatattgcgtagatcagtggaagcttctttaccacctgatgcaacgtggtaaatgggataaatctctacaattgaattcaaaccagatggtggtatggaagaaaatctagggacaccctccgcctctgggccgtggtcgacttgtgacaatcacgacccggagtgccagcacaatctcaccaatatcgtcatgcggagcgcagatctgaagaggtttactcacaaagccggctctaaagacgcccccgcccgtacccatcttagtcaactcgcgcgggtattccgcaacgagttactggatagtagtacttttgtatgttgaactagtaccaccctctatactcgtaactacatatcccgggaactgcttcatactactactagtacgaccttacatctcacgggaagaggagagatggcagatgagattaaacaagagtatgatacagcaccatcacttattcctggaggagatagtaacatctagtcacttctgtccattccaaatttaacaccaagagaagaagttggaggaccaaaaaggagaagagaacgaagggctgggacaacagccaaactatcagtatagtctagacaggcgaagatggaaagtaagtccattcattaaatacatggttaaccaaacagccctgtacccacattaaacttctttataccctactcatcaagaaccaatttactggcgagctccacgaggatacataatcttttgctagacacgcacaaggccatggtcctcagctacaagtaagccatcgatgttattcttcgacatatagtgtatgtatctgtattactagacccgtaagactagagctactacggcagcaatgtctcagcgaacatgggagaaatataacaataaagaatgcagaattctcgagattcgatatacatcatgctgttcccgagggttgaactcagaagaatgctaccccagggaagttgagtcctgaggctcctaccattatccatcagtgaactgacaaaatcacggcctttcacccctcctcaatgtaaatggcaaagtaaatgtccttccaactcccatttatgatgcgcagtgtcgtcaaagctttgaagtggactcgatggttctagaatcagccgataactcttcgttaacatatctggtcgagatggaaatggtgttgcttccgttcgttttgactgaaaagtagccgggatttccatattgatcgtaaatagtgaaccaagtatcttgttgccagtttgaataccaagagacccagccgtttccgaacaagagacgagtgagacacaattcgttcggcctctggttgaccgtgaccttcgcgcatgtatctataatattataatcattcgaagcatacacaccgcgccacttcgtgcttgaacctcccatttgcggcatgaaaaatatgctgacgtccctattgttacccaagcccaaataggcaaacgcatcccggaagtaagtattccgtccatagggctgctgtgtaccatcggtatccacatttttaggatccactttcacaaatggatagagtttggatttgatatagtagttgtcttggtcccaagcatattcatacctcttctcggtattcccaaaccagaccctcttggaccaaaaaccttcggccgtatcttctcgggtaacggtaacatcattcatcgtgtaagtgattggctgcttggcgacaattgtaatgctagaatcataagtgccaccggtcgtagtgacaattgctggtttctcgccaagctccgtaatctgggcggcgatccttttatctccaagcgtggttgatgagacccagagcacaacagtttgagaaccatccgcattgggcacaacgggtgctgcagaaggcagctgccctggcatagtatgaacaaaaatctcgtcctcttccctggaataagtccattttcccgccaactcctcctttgtgctataatcgatcaacttgagactctccaggtctgactcggtgagctggtagggtgtattcaatgtgtcgtaaacggtggctttgattctgacgttaatctgcgcctgcatattaccattggcaaagatctctctttcagtctcattctggacatttgtgcttagactgaaattcgcaacttcccacttgtcactcattttgattgcacgagggagtttatggcagaagaaagaaaggaaatgaagacagttatcgatgtgtcaggaggttggaagatgatggtttaattttgtaaagcaggttagggtgatactaccactgatcttatatattcctctggattgttgacacgctactcgtaggcaacctttggtactagttttcatcctacgaaggaaaactatcagagagggcgaattctggaaagttgagagccaagaccaacgtcactctatcttcggcttctatcactagtagtagtctactacatgcatggacagctgaaggactaagggaatccttccctgattgtgtgacaatagcagattacatctacatggtctgattggcctgttacccctcatcttgaagatgtctctcacacgaaggcgcccattttgccaattttgccacgcttcggggtttgcagctagcttcccgccatattgacatgcattagccggtccgctatacttcctagtgcgactgcgatcgggatttggatctggagaaactctccaccctgaaactaggcgttataacctgtccaaccactcggttcaagctactaccggtggaggacttcttttgaaaaccaggtagctacgctgcaccggcctagtgtaagtcaaagattgacatccggcctgacatcggcgtgtaatacctttttcggcgtcacaccgtagcgaaagattccccgcccccatcaatagttattgttgactattatcaattctgattggaataatcagagtatgaggatcgggatttggggatatcggaataacttctggaaaacttggctaggcttgtctgtggagcgagtgcggattctatacttccggtagaatcgcctgcaagaatcgtccgatctctttggcaatctcgccgaggacgagtctatttgcccgacttgtcgacatagtgacaatgtagtaacgagaatcactagtacatgacatgtcctgcagtctagctcagctgccgctctctcacggaattactcgaaaaaaggaaatgccggaatagactcttgcaacgcttatgaatccaccatagctagggagattgtaacattcctgagactgtattgattcccggggaactatacagtaacactcacctcaaagagttatcacagtaactcgctaacagtatccccagtctctgatgcctgtcaagttggcgggacaaatttcagacgctctgtatgcatgagcatcgatgtattctgaacatggttcctttctagctcaatccggtcgacgacctatcaggacagctccatgatgcaggttcatgcagtgtgattgaggtacttcagtcggggcattaactaaccggccgctccgtgccttggtagcattgagtacctcttagcgtgtctccttgttcaaagcaaatcccgatcgttgctagaaaacgatggtgaaggtgaaggtgatggtatcggcccataccaatggacgctaagaggtgctggtgtgattgccacggattccccgtcttctcctcattgacgccttccagccctcaatgagcttggtggcgtttcccaagcagccggacttgtactctctactctcatcaccttccttgctatttgctcggacactaatggttctcattgccactttgttatctagctcggtctggactcaatatgagcgaataacctacacaactcatgtgatctgaggggaggggtctgcttttcctacggatgagaaagggacatggggttgttagaagagagaggaggggaaggagaggaggaagagggatataaaaatccagtgaatccggaccctgctgtcacctcaacaaccatttgtcttctgccatttctccacttcatcatgatctactctcagggctttaacttcaactcttacgtcgagaaaggggttgaccctcgcaccggccaatacaactgcaccatttctctctacgaggtgccggctggggttcgcaactgcccgcctctcaagctatctctccattataaccccttgaacggcgacgatgtaggcctgggccagggttggtcgtttggcaacctctcctcctacgatcaaggatccaagactctagttttgtccaccggggagaactacaaagttcaggagaccaccagctcggtgttcccggcggaccagaagctcaagagcttcgtgtttcagaaaaagagtaccacgagctaccgcgtcaccctcaagtcaggccaggtggaagtgctctcgaaatacagttggtctactgtcagcgtaccaaccgagatctatggttccaatggccgcttgctaaagctctcctgggagaattcggggactcagcctcgacttagcaagatctagtccgacttgcaagtcctgctcgaggtctcctacggcacgtataccaccatcaccctggctccgggaaccgccgaggccgcaaccttcacactgcggaagaacaacaatcagctgacggagcttcggctgccactggatggttcgccagcgtggaagttcacgtatggtaccgggggactggtcagcgttatcagcccgacaggtgcaagagaagacatctcctacaaggcagcgggcttcctgctaccgagtggtgctccagtcaattctatcccctacgtcatctcccatacggtacggccactccatgaccagcctgcgattcggactacgtacagctactcggaccgtaacttccttggctatggcggaggccgcaactggaccaacgacggggacaacctctacctgacaccagctgactacgaatacacctcaactagtcaggtggagggcggcaccactaccaagcatacctataataaattccatctgttggtcagcaagcaacagcagaagggaaccaagcaggtcacacaggctaccacctactatgccttgagcaataccgcctttgatggtcaacccgctcaataccaactgcccaaaacccagaccaccacctaccgggacacctctaccgggaccgcgcgtacggagacaacccaatccacctatgatgactggggcaaccaaaccagtgaagttcccccaagtggcatcacgaccacccgcgattactacgaccccgctggtgaggtggtgtcgggccaggtgctttgcccgcccgatccccatgggtttcagcgctatctcaaacgggagaccgtggtccccgcaaccagcaacttttcaacaccaactcgagcacatagctatacatatctccagctcccaacgaccaccgatgccctgacagattactgtgtggccgtccagcagcggcagctgaccgaggagggtcggacgctctccagctcggattacacctacgtgaaccaaccccagtccacagaccatgggcgagtgcagcaacaagtcacgcgcttgcttgatcagagctccactacgtacaagtggacctacaaccatgacagttctttaaaattgagaaagaccaccatcatgacgagctatgatggtcagaccactcaggaggagaccacatcctccctggtatccggactgaccctcgccaccaaggaccgggcagggaccgagaccatgcagcagtacgactcgatggctcgattgctccagaccactaccgcccccggcacggccttcgaggctacaacagaacatgcatatgcggttcttgaggacaccgcgggatggcgcgtcacggtgacggacaccaagggggtacaaacacggtacttcactgatgggttggatcgtgtggttcgggtggagtcccaagacgatgatggccagtgggatcaatataatgcctacaccggaacattccgggtcgtgcgggagcgccgctacaacgccctcgatcagtgtatcgaggagacggagattgactggctgcgagccaatgggaccgccaccacggagctgaggataacgcgctccctggagtacgatgattggggtcaggtctataaggttaccaagaacagcggctctgtgcagctttccgtgaccgaccccattgccttgacccagacggtgggcttcgagggtgaaggccagacccgggtccaatacaacacgttcatgaccccgacgtccgaagccctggtccggcgcaacggaaccgtcgagagcacggtggaatatgcctatgatggtcttggacgccgcaggcagatgacagatggcttgggccgttctacgcagtatacctacgacagtttcgatcggataattcagaccacctggcccgatagtcactctattaccacccagtatgctgcccaaagtactgcagccctgcccgtggccatcaatcttcagggtaccacagactttagtgagcaatcatttgatggcttggagcggctgctccggaccactgtcggtgggcgcactaccagcagcgcttatcaaggcgtccagcctgtcccagcccaagtcactgatcctaagggagagcgaacccaacgcacgtacgagccggcgttggattatgcactgacaggccgggtaaccagcgacggtaccgacgcctaccagtataacaagcaaaccggggatgtcttgcagctggacagtccgcttgtcgccgccaacctcagctactacccctccagcttggtgtcccaggagactgttgaagtcgcggacggggcacgcactgtgcagtacgtatactcgcaagcaggtaagctacaagagtacactgatatcaacgggcaacaacatgtgactcagtacgatgcgtatggtcggcggcgggagatccgtgtaggaacactcaagactacactgagctatgataaggcagaccgcgttgtcacgactgtggcccaggatagtagcacaagcgtgactctgacaacgaacattgaatacgatgaatttggccgggagatccagcggacgatctggaacgggacaaagaagttatcccagtgcacccaggcttacgatgccacagggctagtgactacacgccaacgaagcgatggtgatggcactgtgacgcggcaggaaaccttccagtacgacagcctgagtcggttggtggactacgaatgccagggcacacagcctccagtcgatgagaaaggacgttccctgcgccggcaacgatttacgcttaatggctatgatggcttcacccaaattcaaacctcgtttgtggatggcagtgagaacacccagagctatacatacagcgcccaagacccgacgcaacttgtccggatcaccaacacccaccctgacgaggcgacggtgattgacctcaagtacgatgcgaacggctgcttaacaaaagacgagcatggccggacactggtatacaacgcgtcacatcgcctggccgccgtttatgatgaccagaaccacctcctctgcgagtacgcatatgatgcgacggaccggctcgttcgtcagaggatccctaatgaacccgatactcagttctcttaccgcggagacgccctggtagctattaccaaaggagaacgtcagactagcttcgtctcggacggcggggtgtactcgggcgaagtccagaagcagggaagcaaggtgaacatccaactctggggttctgacgcccagcactcggtctccacctggctggagacgcaggatccggagcggattcacgaccagccgtacacgccttatggtttcagccacggtagtgggggtgcggccattggcttcaacggagaatggcgggatccagtcaccgggtggtaccatctggggtcgggaaaccgggtgtacaatccgagtctgaagagctttctccagccggacccatggagccccttcacctccggggaaatcaacccgtacgcctactgcttggcgaatcctatcaaccgcgtcgatccgagtggccattggagctggcgcgccttcgcccagtggtcagtgggcctggccgtcggactcgtgaccgcaggaaccggagtcgcggtgggattagccgccagcgtggccattggactcttcgtcaatgtgatcgtcggcgttatctatgacacggccacggggaccaccccaacataccgcagtcttgccatggatgcctttacgggggccattggcggttttgtcggcgggaacgttggcatgaatgtaccggcgtcgtggggggctaatccagtgagcgccattgccacggaaatagctttgaccctcacattggacgccatcgtccctgatcccaccagctctctcagttctatgtctgataactccttctccgctgctagtttggcttctgggggctccacggcgaatgattctgcgactaccatcccaggccgcattccagactggcccatggagaaacttcgacagcggggaagcgcgaccaagaaacagtcacaagttcagcagcagcagcagctccgaacggaaacgggaagtgacacgggcacctggattgcgcgagctacttcccgtgagacagtcacgacagaggacatcagcttgaattccttcggaggcagcttcgatggatcgcaattcaccctccagctgagtccggatcaccgggtgtcattcaatatggatgcaaaggcggtgcaagtgccgatttgggatggttcgggatctttgttgagcgcggtagccactttaggtcgactgtagtggtttgtcaagacgttactatttgtgctccggataatcttaggagccagtcagccttggacgatgtgaagccaaccttattgaattagatgctcctcataaatgttccatatcatacaatgaagacccttctaatcagtaagtacgtacggttttatattctctagtatctatcaatagactctacctgtggatcctagacgaaacagtaaacaacgttcggctgtcatcgtcaaccctaagcgacccgggcaattgccgccaagcacggaccaggttgtgctcgggccaaccaacggatttaattccctgctcgcacagttgctatttgtcttttatgacggccaggggagtgctggaccgtgccgcgccactgaaggatgactggcggtctagacggtcggtggctggttggcattgagtcaaagaagtggtgagttctcgtattcaaccccggattcatgccagccacgtggacccgcaaagccccgatcagaaaaactgggcctccaccgcatccccccctccatctgtcttctttgtctatcttccttttccacccccatctttccgaattctccgctgtgctgtcactctcccccttactgctctctacgtatacgctctcctaaattctcctgtagcctacgggctgacaccatgtcctccaattccaccaccaaagtcaaggctcaaggaggcatcctcgaaggcagcaatcccgcccattatgactcgtctaatcccatcgttattttcatcatccaggtgggtgttccctgctaaatcttccaaatgctactctgctaacgtcgatcaggccggcataatcatcatcttctgccgcctgctacactggccactttccaagatccgccagccgcgcgtgatcgcagaagtcattgctggcgtcatactaggcccctcggtaatgggccgtattcccggcttcaccgatgccatatttccaaccgcctctattcccaatctgaatttggtcgcgaatctggggctggtgctttttctgttcctcgtggggctggaaaccaacctgcgtttcctggtcagtaactggcgcgtcgccgttagcgtgtcggctgctggcatgattttgccctttggtttgggctgcgccattgcatatggactgtataacaccttccaggatgaaccggacacggtggatattaactttggcacctttttgctctttatcggtattgctatggctatcactgtaagtcgtttttgagtcacaaaccgtcttattttgctaaccgctgggaaggcgttccccgttctgtgccgtatcttaacggagctcaaattactgggaactaatgtcggtgtaatcgtgctctcagccggcgttggaaacgatgtcgtcggttggattctactcgctctgtgcgtcgccctcgtcaacgccggcactggcctcactgcactctgggtcttgctcgtctgtgttgggtacatcctgttcctcaccttcatcttccgaccacttttcctgcgcttcctccgccacacgggcagcctgcagaaaggacccagtcagtctgtagtcgccatcacgctactcatcgcactggcctcggccttcttcacccagatcatcggcatccacgccattttcggcggcttcatcatcggcttactatgtccgcacgagggcggcttcgccatcaaactaaccgagaagatcgaagatcttgtcgctgcgctctttcttccgctctacttcaccctctccggcctccaaaccaacctgggtctgcttgacaacggcaccgtctggggctacgtggtcggcatcattgccatcgccttcacggccaaagtagctggcggtgctctcgcctcgcgactttgcggccttctctggcgcgagagtttttccatcggtgtgctaatgagctgcaagggtctcgtcgagctgatcgtcttggtatgccccttcccttcccactatcacactccccaactaatcaacccagaacatcggcctccaagcccgcatcctcagcactcgcaccttcactatgttcgtcgtcatggccctagtaaccaccttcgccaccactcccctcaccgttgccctctaccccaaatggtaccaagtcaaagtcgagcgctggcgccgcggcgaaattgactggaagaccggcaaccccatcccctccgacgcccgcaccgacagcatcgcattggccaaagaacagcaccgcgctcttcccgtccgcaaacttctcgtctacctgcgcctcgacggcctctccagcatctgcactcttgctgccctcctttccccaaaccgtccccctctcccaaagcaacacccggacaccctcgcctcccctgacccggctgccgaagaaacagccacagcaaccaccaagacagaagaagacgaagaccaagaagaccaagaccccaaacccacccttcaagtccacggtgtccgcctcctcgaactcacagaccgcgactccagcgtcatgaccgtctccgaactcgaccaactccactaccccgtctgggatcccgtcgtgaacaccttccgcgccttcggccaatggcacgatctttccatcgtagccggcgtctccgtcgtacccgaacactcctacgccgatacagtagtcagcatggctcgcgacgactcgactgatctgctcctccttccctggagtgaaaccggttccatgtctgaacaccaccccttggatttgaattccgttctggatgatcccaatgccacccgcttcgtggcgtccgcgccgtatacggctttcgcggagagtgtgttgcgcaatgtgcggtgtaatgtggggttgttggttgagagaacgccaacgaggagaaataatgggcgggggctgcgcggtaagccctcgcttggggggttgagtatacatagtgggaatttgaatatgggtattggcagtagtggggataggggtgttgcggtggtgccgacgacgaggaaagcgcatcatattctgttgccgtatttcggggggatgatcgcttcgcgattaggttggtactgcagttgattaggaatgatcaggttacggcgacggttgtgcatgttgttggcgatcggacgccgattgctacgccgaaggctgctgttgctgggggtcttgtgggaggggtgaggaataggaagaaggatagtagtagtacgagtagcagcggtggtggtggtggtggtggtaagaagcgtgaggttgatgactcggatgcggtgtatcttactgcgttgaaggattcgttggatgaggatgtggcggcgcggatggtattcaagaaattggttcttgcgggtgggatcgagcagagcagtagtggggtggtggagagggtggttgagcatgtcaaggaggaactggggagattagggtctgggcaacgggctggtgggttggttgttgtggggagggggagtgtgggggtggatacgatagtggatgatggggatgaagataaggatggcggaggggtattgggggtgctgggggagaagttggtgcagatgggtggtggggatgtgttggttgtgcaggcgagggatactctatgatacgatgataccctttaatctaatcgatctactttgtttacagtgaaggcaacagtcatgaagatgttcatgaaaattctttttttttcattctcttgtttcagagtgggtaacatatatacttggtcaatcataacacccgacaatctcatatatacacatcaatagtagtatctatccatccgaaccggggacagacagaccgaccatagatcaaggggagagggacgtaagaacatttacacaccctgaccagcagagtcgttgggcccttcttctcgccatcgccatgcacaaccagactagcgagcttactcctagcccggagctggggtccgtaccagaacagcacgtaggggatgagcgtcaaggcagtggcaatcagagccaggatcagaccggcatactgagagcgacgtgtgaagactggaggcgacaagggggacacggcacccagggtgttacgcatgaaaccctgaccggcgatagccgaggacgagctctcaccgtagcaatcggaggtgaagctgtagcaggactcgaagatgaagaagataccgatggcgatgaggaccagggcaatgacgggagcgatccaggggagatcggcgtactgggtgaaggagtagatgaagagaccgatggggagccagacggcaccgtaaagggcaccgtagagacgagcctcggggcgagcctcgccaatctgaacaagggattcgtacttgcggatctggaagaagttgagaccgaagcccatggtggttcccaggcagagtgcgatgtagggaagaccggagacaccctcgttccagcccttcttttcttggaaggtgatggggatgacgctaaggaagaggaaggtcaggaaccaggcgaaggcgatccagagaccgaaggcgaagacgacgggttcggtggccagcatcttgatggccttgacggaggagttgtgaagcatggtcttgagggagggggcttccaggtcgttctcggtcacgtagcggtcatcaccggtgtgggtgcggagggccttggcgcgcttgccgagagcgacgctaccacgggtttccgggaggaagaagaggatgacgaggccgaggggaatgttggcgagaccctggataccctcaacccaacgccagcccagagcctgatcgatgaagccggcgtagatgggggcaccgacggtaccgaagatggcgatgaaagagaaggttgcaacggggatggcgcggtcctcggggcggtacatgtcaccgaaggtaccaccgacaaggatggtaccgacacaaccgaacagaccgagcagggcacggcagacgaggatggtgccgatgttcttgcccagggcgagaccgatgaacataatggcgaagcagaagtaggcgccggtgtagacgacacggcggccagccaactcacagaagggggccaggaagagcggagccaaggcacaggtgaagttgaagaggaagagaccgagttcggcaatttcggtagaggtgcccaggtcggaggccatgtcgctgataccggagctgtaggctgttgtggcgagaccgatgaagagggtcatgagacagagaaggcagctgatgaaagccttgtactttgggtcccagttgaaggggttctccttgtctcccgggacgaagtcgaggacgatgtactggttaccgtcttggaccatgcgttgggtgacggtgacggggaggtcgaagtcaacggtttggagggggccatcatgggccgagctctcgttgacaccctcgaggtatttcccaccggccacgcgacctgacgccgttgaggcagtcacgctggaggggcccggagaggcattctccgtatgggaggagagggcgggctgggacttgtccattttgtccatgttgaagaagaggaggaggagagggagggaggaaagggagaaggaggagtgagagagaaagaagaaagggtcaagaattgcgggagatgggggaaatataaaacaaaaacacgggggaagggggcaagcccgcaagcccgttcaactccgtgggtgaagactccggtttttccctcctgtcggtccacctgcgcataagcgatgcttcgatatccttctggggtgcgtcataaagtcggggtggaaactggacggtggccccgaggctggagaagttttactgccctgcacgaatgatgccggccagggctagcctggtggacggttgttgtccacttgtcctgcctccgccatccaggcatcacattgtggttcaagtgggccgcaaactctgcggtcgatccattctggatcggttggtttggggtctgagaaacctcggggaaacttgcccatcacctgcctgttccttgccgggatcagatttttcatctttcagagagtaaatctctttacaggcatttgatcttctttgaagaaatgctcccacacgtttctctgacactgatatccctccctacaatgtacagccagctctcatatccataccccctgttgcgggagggaagggatgatcctcggaactcgcccgagatcagatccataacttggatcatcggccaaccctaagccaaccgtcgaccagtcggcatcccgagaaaggcaagtcagccatcgggccgactcggagccttgccactcactgggtccatcccacgcttttcgggggtagtctcgggttgacctcggggaaaagacctcaccgcagctaaaccgggaagcagctgcagcaagtcgtatgcacgccgtgtctcacgtttgcgcaccatgccgactatccccagtgtcaagggtcagaccggcaatgatcgtgtgtcttctccaggattatcacaaacttagccgcctccatactccggactgtcaatcctcttatatgggtgtttgccggggtgagctagatatccttgaaggattccagaacctctggtgaaattaatgaatctcggttcaactgaaacctcgtagactacagaaatcctcggggtccaccagtccaaagcagttagtcatgagcagtggacgagccagcttggactgtgccgaacaagccggctgacctgccttgagatgcacctggaccactctggatgcgtgtctcgcgcctcgcgtagagctggtagatagtgctagactatagcgtcaatctcaccctttatccggaagacgttttagcctaaaaacgtgttattcgcgcttcacgactctgacaggcaatgctaggcgggatgtcgggtaagttttgctgcgttgattgtttggcaactgacacgtatgggatgagagctccacagctccgaaaagctgccaggattttcgggtcgggatggagaagtgaggatgcagatggctgagccgctgaggtgtgaggcgccgagttcatccgagccagagactggccagcatcgtgacggcatgccgtggatgccgtgcataagacggaggcagttgccgtcgcgaaggatgccgaactattgcaatcggctcggatatggagtggacagtgacttggcgatatgtcataataggggtaaaccggcatctgaggttattgaccgtggcaagcatgagtggcctgatgcacgagaggataacatagtaacgttgatgaattgatgccgaaacctgtaatgaagccggtggtgtgaggagaggagagaagccgaagccgcagtggtgagatgattcctccacatttgccaatgagacataatccccgaagagaaaaagcaaatatcaacagttggccggatggtgtagttggttatcacgtatcgttaacaccgataaggtcctgggatcgagccccagtctggtcatctctttttgcccgttgaattttgttggggtcctcgctggtcttccgtttccgttcccaatttttgagttcgaccttgccactccaggactagcgcaaaaaaatatgcatactgcgaataagtctaaccttgttgagtctccacccgttgcaccgccctcggagccatggctgaaaatggtttagtgcaaggccgttctcgtgatttttgcacgatttcttttcaagacaaccattcaatatctctctcactacgtcattggtggtagaagaaccacggacctgaagagaacagaaaccatgcatgaggccaaggcacaggaactgaaatcatcaggagacaccgcttgtttcctgtcatcgtccttcgtctcatcatcatcatcacgatcgtaacaaagtttcaactctgtggtggctccaccgacgttgcagcttaccccatttagaaacccatacgatctctcaatgatgatgatcatttatgcccaataccgatcctgtccttctcaactcggttgatgtggccaagaaaatactgagcatatgatgcgcacatcactcaagcaacattcaccctgtgcccaacatccacattacctcggggctgcttaaccttggtcgttgtgctcctgattttcagatcccgcactgtgcgacgggaccgcatgaaaagattgtcagtaaaggtttggtccacaggtggcaaacctgtcacagtttcttcctttgccctgtacagtaatgatgtgatgttactcagcagcccaaaccgcacttcttgggtgttcgtccacataggttatcacgacttcgaggtctatccattacttgacgcccaatggcactaatagagaagccctatcgcagggggcattggagctgctataatgacggtaacatgaggcgatcatgttccacattgtggtattgattctgcttattcatcgagtctctggtttgttggggctgtggtaccaggcagatgtagtctatatctttgaaacgttttgtggagattgtgcgattcgaaattttcgagcccacaaggaacctcgatcgtaccaaacaccggaatgattagatctcttactgactagcaaacaaacctagtgttttcctaaatgatatcttgcccactcagcgtgtctcaggtaaagccttgggcttctaaactgggtattcaggtggactgcataaagcttcacaagcactatgatcattcgaaaacaaaattcgattggctagattctgtgagggccactaggagggccaagcttataggggatgtgcacctgagcctgttgggtcagaaatttagtcttttttcctgatagtgtagctgagaaggaggaactccattcgtagaagcacgcatagggagtggccctgacagatgctacacacacagctggacttctgtgtagttataaacatgacagggtttccgtaattacatatttccttgtagatttatgctgcttgtcctagggccaccggcgctcttcatggttatgtctcacccctcagtcccaagcccaagtatgcatacgatatgttggataaaacagcagattgtatacaaagtcaaaagtgataaaaacaaaggctcgcttattgtacgggttgtccagtgtgattcgcacactgattggggcaggattctttgcatattttaatgaattctgacagctggttaaagtcgccctggatccatttagtggtcagaactcgttcactgttttcaaatatataagtaccatacaaagcaatggtcagaactctgcaaactccaccatcactcacatattatggcgtaacgttaatttgtaattttttaaccactctgagtttatttatacacatctgagttacttagcttctagtcactggacctgctcggatctacctgatcatgttcgtgaagtcatatccttttgttgagcattcctgctattgtctttataatttctccttatgttaacgtgatccatatcaacgacaaggcgacctttatgaatagctgtacaataacagattatataaaattagcatagttccaaaattctaaacgaaggttaccaagcaaacgccggtctccgatcccgggtattaatcagaatatccccatatatgcgcttctctcctcttagcttcatcggtataagtcgccgcattaggaatgagaatattcgttgcttgtcttcagtcggctgatgctgggattagggagagacgactggggtattggaattccttgcttgattacccgcgtcagctgaactacataagaagttaatttcccattattcaaccatgagagatatatagtgccgcaattattcgcaagtatgacccttctataattggtgcgtattttgttaacgtgtaatcacagagtgtagtcgctcttagcctgccaccggaaacctggactaaattgtcctgagacaccggtcaaccagtactccagtgtgtatcgttctttgcccagttgaacctttcagtaactgcatacagtaaacttagggcatcagtcaacatcgtacagcaagaatttaaacagactttctttgtttttggagcaagttggaccgtaaacaagcgtgctgattgctgttcgggctacatatatatatctcttccgaacaatgcatatagtcccaaaaacccaggctgaggatacagaaattttcacaaagttggctaagaataagtcagctgcaccaagataacagctacgtctgaacagatttgaggtgacagaaggagcacgaagcacaataacctggagaccgtcaatattgagcggaaggaaaaaagaaatccaaaaaacaaatccctctgagggattcgtacccatgctgctacggagctgggtggagacgtataccctgaaggtggacgaccactcgactattggggggctaacataaaaatataagtaagaatattgtctcttgactcgcactcccaagcttgtagaacatgacattctagccctaaccgctgagaccaccatcgcggaatcaatgttgtcttcgaggcccacttgcaattcgtcaggtccaggttcggacttagacatcggactccgttgactcaggttattatatgcctatatatgggttaagcagctatgtgcctaataggtgggtcattcgagaagctatggataccacgtcccttccttgcccctgacattcacggaatacgattaagatctccgatacacagcggagataaccccggacatcgatctaaagccgggcccaggtcccacggtttgtggagtcaagtgccgaccttccgcaaactgcatttcctgctgtcaccactcttcagacactatgtacatgaggatgctactgcgatagattgcgaaagatagtaatgcagtaccggcttaccttattactttaatatctgccatgtgtcatacaatcaggccaaacgtctcattaaatagatcagaataccccaacttttgaggcagtttagtctgaaatgacagccgtggttcactcgccgccccaccacgctaacgctcgccatcgcccgtatatccgaactgctcaccaaatctctgccagtttcggatatacacagccagcaaccagcaataagccggatatagcaccccgcaaggaccttaactctaatatgccacagcgggtccggatagaagacgcggcaacgtctcgacctgcagactcctctcgctgggcgctaactgcgcgctcgaattccgaagcggaaccaaaccctgaagaagtgacagggggttgcttcaacggttactaatgtcggtagtggcgtctgtgtttccttcaaatagaagagggggtgcccccagaaaaacgaaacatgattgatcctgcagaaaaacaaatcacacactccccggacataccaagatggtcaccacaaccgcaattcccctgataatccacggcaaggatgtccttatctccaatagtgaccgcaaacatcccatcacgtctacatccgcacctcatttgaaatccttccaaggcgcaacgcccgatctcgccatccaagccgtcgaatcctgcgcaagtgccttcccaacatggtcgcaaacaccccccgaggaacgtcgacgtttactactgaatctagccaaggtaagtaattccatgcactaaatttatggaaaagtaattgtgtctaataagaagtgaatgtacagctccttcgcgaaaaatccaacaccattcagaccctcatcaaagatgaaatccactgcacaccactctggtctcacctcaacgttgaaatcgcagccggcattgtcgaagagaccgcttcagtaataacagacgccattagcggcactatcccttcgtcgcagggaaatacgtacgcccttgtgatgaagaagccgctcggtgtggtgctgggcatcgcgccgtggaacgcgccggtaattttgggactgagatcggtgattccggtaattgcggcgggcaacacagctattttgaaggtgagaacttgagttactattatcacctatgaggaagaggaatttgttgctgacaagagtagggctctgagttgagtccccaaacgcattacttcctcgcggcactgttccgggaggcagggttcccgccaggagtcattaacttcgttctgcatcggccgcaggacgcggcagagatctacgagtgtatgattcagcatccggctgtgaagaaatgtaacttcaccggatcaacccaggtgggacgtgtgatcgcgtccaaggcggcgatggcgttgaagccggtgctgttggaattgggtggcaagaaccccgtggtggtgttggaggatgcggatttggatcaggcggcggatgagattgttgcggcgggatatttgaatgtgagtatctgcatctatccatggtgctgtagtggaggagaatgtgtgctgacaaattttgccaacagaatggccagatttgcatgtcgactgatctcgtctacgttgttcgctcggtggcggaggagttgactaagaagcttttagagcgcttgcacagcgaagatcggccacacaaggttatttcggcagcgagccgagcccgtcttacgcagttggtagatgatgcgcggtctaaggggggtgtcattcaccaggctcgtaaccctctcgctgaggatcccttggcattcccagctactgtgattgaaggagtcacggaggagatggagttctatacgatcgagtcgtttggaccggtgtttggaatcatcgctgttgattcggcagagaagggtttgcaaatggttaagcggtccgcgtacggcctttcatcggcggtgtttacgcgtgatcatttcaaggctctggaaatgtctgcagatattgctgtgggagcggttcatgtcaacgggggcacggtacatgacgaaccgacgttaccgcatggaggagtgggcgacagtggatatggtcggtttggaggaaaatggggcttgaatgagtttttgcagacgcaaacggtaattttgaatcgggttcgggcttccctctgatacatgaaaagagatattaggcatgatctgcatgatatacgtgcattggttacatgtggagagatatatcagctgggcatatagtatgaagggtcacacacagccactaattcaactctcttcattacctgtcgtcctctccactgtctcaaataccagaaagccctcttgataactcaaacactatttcatctgagtgcattagatgaaatgctcgcctggagccagatcacactctgcacatgaatgaatttggaaccagagagtccgatggttactgatgcagccatgtttggagggccgacgttggagaaggagacatctggctaactatcggaggtaaattggatgttaaacttcgaggcatcacctggatcattcgcgaatcgacttgatgtctattttctctagcttgaaaccactacaaatcaggtaacccatgcaacgaataactcacggcttcaatacttcgagtgatctggtcagtatccaatcctcctgtagctcggattgattagatagtgtagaacaacaccaaatttcccaccatcccaaacccaattacggtgtagaatcagccgggttcaatcatcaatattgccgtaaccaagggataattgtttcagtctactgtgacctctcgatgacgacccatatcacatagcgtcaaatatattttgtaatctagggaggcgcgttgttgtgccagctacctgccaaactcttgacctcatgtagctcatgtaacagctatgggtatgcaaaataattgctcacgcgatcttgagccacatgatattgtcatgactccccgttaacctcatacttttgactttcaccgcatctctacctcaccttcgtctcagtctccagaatctacttcaccctttcaaaaacctttcacttcgatatcttcccacatctactctcgccacacagtacaaaatggatatgcatgaccccaagggtatacagggacagggagaaatcgacatgactgcccttgtaccttatttcagacttggtctcggtctcactcgggctcagggtgaggaagcggagaagccatggcagattgactaggaccttaccgacgttcaaataccagaacatctgggtatatgatgatcccccaaactagatacagcatcgcttctaactactacctttaaaagagactctattggaggacttctcttcagggctcggtaatggagactgtgacgagagattgattcggcctcgactatatgcaacacttatggtgttgctggccaaggtcatgaaggaaacccgcatcagtagagatgatgacgaatctacgtgcaactccgatcttccttcgattgactattcagcgccatgctggatggccgaccagaaactcattgtttcacctgttgccgactttgcgagtcaccccgtggagatcactatgcattttatcctactgtacggccggcgcccaactttggacacaaatctcattgtgttgaggaaacagacaatccttcctgacgaggactggggagtccttgcagctatgtgtaagttcattcacattccctctttatttctagagttaacggacattgatttcgattgaccagccgctattcatcgccagcggaaagaggcaggcgataacggggacatttacggaatccataccgatacctatacctggaatttcttccacctcaacaatagcggcaaggtacgatctcggacaccattttcttaccattcttttcctgcctcatttccccgtttgactgaggctgaatttctagaatacagtattcaaccaaactggatttgtcctggtccttggaccaaaaggaggtcatcggtcgcatctgccagataataagagaagctagagctctttcccgaaaggtgggaggtagggattctatgctgggcatctttgaatcagagaccgaagaaaatagtgatgacgaaatgtctgatcactcttcgctctaccaaggaaaacgttgatgtgttgcatcggatagaatctaacgtctatcaagtggttctgctgctgtgtaattgctagtgaagtatcctgtcattaatttttgtttttcagtcattgatgatattcaactcaactcaattcaattcatattaagacaccattttgtatgcatatggctcttcgctggatttatcgaatgctaatggcccgtaccttgagttcgatattgaacttctacacggacatagagtagccgccaagcttgttgtctaactactgaatttatactagactgagtgtgatattctccgaggtgaccgttgcatggtgtaacgcagcgcatcagctggtactgtttcatccctgttctgtcctacattttattgtacgtggcgtgacatgtgatcatttgttgtgaatctccgcagccctggcacttgtgttagttttattccgggtgatcggaagtcagctcattgtctgtcctacatgccgagaggaatgttacgactttactttcatttagttacatgcatatgcacacagcctgctatgccttcgattatattacatgtttctgttagtaaatgcgtactttatgctgcgtgctcgactatatggaaacgcggccttttacactatcgcgtattgcggtgttgtcagatattggcatctcgcaatcgacggaccgctcaataatagaatagatatccaagtaggacgtaagcctaagaatcagtaacaagtcattgatatcaatagtttgtgatctgctcgcatagcacatgcatgtatctttttggtcggggaaatcgccatggcatacggattgtatatagaacctgtgttgagcaatctcggaaagggatctataaaataaacttaaaagtaaaacatgaacagatagattatctgtctgaatactgagaaggtatttctacagcatgcatagcatagccccgactaaattaatgccatcatttttcaacatttgcacagcatcgcacggccttacccctcgtatagacgtggatgcacataatggaccgtcagcaacttgattacttatttcagttttccaagtcccatatatcccttcgaatacctgatgtgagaaagtacaagtgtccatccgccagccagccagccgggccacccgagcagtcaaggatgcgggactcagcccgtcagacggaaaaagagagcccgacaaaagaacgaaatgcatgggaccgattgtaacgtgggggccagaaagtatgggccgtgagaatgaggctagtatatggagatgcagggcgctaatgcatgttcaaactctattgaattgctgactgctgtagcctgatcacccattaggcgttttgtggctggaaaggaacgcatgattcgagggaggaggggaaagaaaggagatagccgtgggtcagaactgtatcacgacaaagaagtattagtgaaggatactatagggaggtagtaagtgatgggatagaaagtagacgcggtgaagtccttacagggatctctatggatgaatttagtagggctcgcctggcgatccccgcccggatgacttgcaaggctcctgaatctattccaattgatcttcaaccgagcttcctctaactcccatctgtagtatactgttccctcagacactcattcatccacaccactaccatcaccatcatgtcctggaccaaacaaatcgaccactggagccgtccccttgactgccacgaccgcctctttcaattcatcggcgagtcaggcaaaccactcggtcgcgaacactggctcaccgtcggcgccgtccagctcgacttccccaacagcagccccgagataaccatcccacgactccgcaacgcctggaaatctctacgcatgcgctaccccgacatcgcaggcgagctccatggccacgaaaagcgctactacccgatcacgagcgcctcagccctagaatcctggtgcaacaacaccttcaaaatcgaagacttagcccaatccgccgacgacctcttcacccaccacctgcgcatcgccgaccggcacgcaacggcacactggatccccagcagccaggaattctgcatcgtttcagcccactggcgctgggacggcaccggactcgccatggtgctggaccaattcctctccgagcttcaaaaccccatcaccaccaccacagcctccttcgacggcagcgaagccacccgactgatcccctcgctcgacaccgtcatcggtatgcctgcctccccgaagccagagaccccgaatggtctcgtcgcgccgacgaactcctcgctaccttcctcgagggccaaccctcgatcggcctgcccgtgctcaacccacagccttacccgccaagtctctccgcacggagcatgtcatccccgcggaacaggcgaccgcgctacgtcgtgcctgtcgcgcaagaaacatcactctcacgacagctatgcatgcctctgcgattatcgagactgcgcgtgcggctaattctaccgatccatcatcgcgctacatctcctggcaagccttcgatctccgcaaatacctgcccccaccctacgacggccccatccacggcccgtccctgcgcatggtcggcctcccgctgaatgtcgaagccacgcccacaacaagctggtcggacctcgtggataccattcagccgctgtaccgccagtcgtggaacttggccgacagtgacatgatgtttgtacgggtgccgttcgtggaaaaggccacggccatgttccaggctgctgctgctgcgggggcggcgcagccgacagaaccaaatattaatagtttggggcctgtggatcggttaatcagggagagttatggggaggtcaaggtcaagggtttggtgctgatggtgcagatgttggcgcagcagttgtatgtgcattgttggagttggagggatgagttgcatttgagtgccagttataatgaggcgtattatgaaccggtgtttgtggaggcgtggttgagggcgatgagggagaatatggtgcggaatttgttggaggatactacggatacgaataagggtgcgttgctttgatgggtatttctatattacttatctattccccctttttcctttttccttttctttttctttttctttttctttgttctgttctgttctgtttgtttagaggtatgttgcgtggttctaacaattgatagaaactatcgtcggttgattatcggcactgtacagttgatacttctaggtttgaatgggcgttggttggttgggtgtggaatacgcttgttgacgccacagtgtttgggtaatgcaggagctggaatcatcgaaatgatgttacgtgtctcattaattaatataaattaatatacaagtagtagatagtagtggtagtagtagtggggcaaaccgcccttcgatctcacccgtggactcccgtccacccgtaagattgtgcaacatgggaaatgaaggatatccagaactcagctcacgagagattctccgggcggagctccgggggcaaagcagcaagccggtccaactccaactcaccagcgctaaatccccttttgcaactgggctggattcagtacccacatttctctataaccccggaacgctaatatagcacccagtttagcggcatccaacatggttccgatgcaaccggagaggggctggggtggggggcggaaagttagggaccatcattgtccggagagtgttggagtaatattgcaatgaatagttgaagtaaaaagaaaaattcggatgaggcccgtgctagaccacgtcaacgtctacactctgcttcacgtagatgtggcaggggccgagctggtccatcttgtacgactcgccatccccgcgcgtgatttccgtctgctgggtgctcagcagcggatcttccacccgtcgatagggtgcgctcttacctgccggagcattgcgcggcgtgttgtcgctaccgtacggatactgtgcagtgggcgtcttcaccgtagacatctttccccgtgccactcggaacagtggggcgtaggttggcaaacatgcgcagagcgtggccacccccagctgtaccgatgaccagaccattgtctcgggagcccgcacaacttggggtgtggccgggatccagagataggagagcttgcagatactggcaatacagaccctgtttcatgcgatcagcaatggattccaagagtgtttgagaggagaccaaagtcccgagacaaaacctacaatccacccagaaggaatataccagtaatctggaccttgcgtgtgcgactgagctgcagtcgcgtcaccacatacacaggtagaaacaagattataacatcaaggaacaagttcgtgagctccatccccaaccagagccgaccactggcgatgcagtattccgcagcgcccatcgcatcccacaacatgtggattgggtgacactggaaaatgttgacgaacagaacaatgaggaaccaagcaacgcagagggcggctgtcacgtagttcaagacgcggtatattttggaaaccttaaagaggccgtgcagaaacgcgagtaccgatagtttgacaaaagtgatggtcgccatgaagaaaaggtcggcgacgtacagagtctgactcaataaagtcagtcagtcttgcgcacgcatacggatggcatcgcgcaacagaccttgagaaatgccttggcccataccattcccccaatgtctgcatcggctgcgaattcgttcaggtcgaaggtgcccgggccaggtcctgcgacaatatctgggtaaccgcaggatcagtaactgctccctcctcgtgttgaattatttaagacgtcgacatacattgaattaacagagccgcaaacaccgtcatgcatgccagcgtgagcagaagcaggccgtcggacaagggagaccactgtcgggtcatgattctcaccaccaaccggagagcgaccgagaccaccgccagcgccagcattgcgatggcggcgcccaggttgtcccggccggttttgccgatgtgcttcatcctgacggtgatgtggtgggatggattgagaagcacgagcagcaggccgaaaagaaatggaaaacacggccgccggggttggtccctcgcgaggctgacttggtgtgccaatcccgagtgtcagtcgatcggcaacagtcgaaagcgcggtaaaaagaaaagaggggtgcagaagaaggtgatgattgatttgaatggcgatggctggcgtcagggcgctagatccgcgaagcttagaggaaaggcaaaaggaggattatgatcgctggctgtcagcagggtcgcataccctggaaccagacgagctgaattgtcatcacacatggaaggattatggcccccatgcgatcggagagtctattcaggcaggggggttactgtacgatcggaggagagtggcagagcaaggagaagggaagggggtggggacgagaccaaacgagacgagacggcgatgagatgagaggaatataagaaatgaacgtaattcgggcccctcgccccagcacagcagcaaatatggaatatagtagaagcactgttcagtctttgtctgtttcttcacttctcatcggcctccccgcaacatgttcgccgcaatggccccatgggtcccaggcgggaagaagggagggcagctgcgggatgggcaaagactcggtttgggatagatggacacggtcgccaggccggataattgccatagcctcctgcttaggcaccagctgggtctcttcacaaggttcatcgatgctgtcccggtttagactggctgtcagcatccggcattaacctggtaaatcgttggccaaccagggtgtggagggcgcgtcagccagcggatgcattctgacggagcatatcgcatgatgcagcagttcgcgatttgcccgtggccctttgaccaacgtttctcggtgtgcagcagccacattgtttggctgtggccgtcgccatggtgtgggtgagattttagggcatttctgggcagcgagtggagcaggccagagaggagagaagaggggatgctgcattagtggcttgtcgatgagcgaccaccgtaccttcttccggtcaatctctgggcaatccaaccgtcacaccccattggcatgtgtcaaaacatttggctttcacacactgcaccgccgtcataatacctgctcgaagaatagcactgacctttccgcccctgcacgatcaactcctcggccaagaatgccagtcctggcgatgatccagtcggcagatatgaggctcaatccgggtacctgttccgctctgtctgtcctcggccgggactttaccttgatatagtagatagctcgttcgagtctactaactcggcacacttttagggtgtggggcgatggctgcggatcccggtcgatattatcttgatagcattccgtttttaacacttttcgactagctctggaaagaactgtactcgcgcttggcgacgtgtaaatgatggattatgacaggatcgtgaaaaggtttctaggccatgcagatccatcacactttactttctatggccagactgcgtttgcaatcgcttaaggctccccatcggtcagactggcaatcgaatgagccccatgagcgattgatctcgtaaatttgatgactgcgacggcgagcggggagaaaacccagcggggagcaaagtagataagaggggactccgacctgccctctccgtcgaggtttcgtttcgctcaacacgatcatcaacactgcgcctcagtagtgccgaataagctatacaatgcaactactaacgactgacggccttgttacccgcggtggagcactgcagagctcccagaatctcgaagggactgatcctgtggccgtcgtgggtttttctttgagattccctcaggatgccacctccccgcaatccttctggaaaatccttcaagaaggacgatccgtcacaactgaagttccctctgaccgattcaatataaatggcttctaccacccagatgcgtctcggactgacacagtatgtatgatcatagctggcgataataccgggccctaacagcatgacaggtaaacgcgcggggcggtcatttcttgaaagagaatgtggcagcctttgacgcaccgttcttctccatgagtcccggtgaggtggaaagcttggatccgcagcaacggggtcttctggaaacaacgtacagagccctcgagaatggtaagactcttaggaaatcagtatgagacgtgggtactaagaatcacggcagctggcattcccgtcgaaagagcagcgggctccgccacctccgtgtatgtaggggcactgggagtggagtacaaccgattcttcgaatttgacgaagaggtccaggccacgtacaaggctaccggcaactcgggagccatcttagccaaccggctgagttggttctacgatctgcggggcccgagtatgaccattgagacagcttgctctagcagcttgattggcctgcatcttgcgtgtcagagcctgcgatcgaaggagtcgcgaatggtgagcgaaaccctgaaacgctgaactaatagtcgctgatatggaatgtgtttagagtttggtatgcggttcacagctctatcttgaaccaatgacaagcgcgatatctctctccgctttgcaattcatctctcctgacagtcgctgtcacagcttcggagctgatggtaacggctatgccaagggcgaagggttcggcgttctggtactcaagcggctgagtgatgctatagctgatggcgatgtaattcgggcggtgatccgggctactgcgacaaaccaagatggccgcacccccggtatctctcagccaagtcaggcagcacaggagaagttgatccgggaggcgtaccgttcgggtggtttggatctcgcctcaacccgattgtttgaggcccatggcccgggaacaaaattgggtgaccccattgaagcaggtgctatcaaatcagtcttccagaaacatcgcagcccggacgatccgatgcacattggtgcagttaaggccaacatcggccatttagaagcgacagctggtctcgcgggattgataaagacaatcctgagtctggagaaaggcatcattcccccgatagcggggctgaaagaggtcaaccctcgcattccggctgatgaatggaatctaaagtttccgacgaagccgcttccatggcccactgatggcctgcggcgagcgtcggtcaacgcatttggctatggcggatcgaatgcccacgctgtcctggatgacgcatacaactacctgcgggagcatggcctcgaagcacaccacatcactgtcaaaagaccgcccaccctcgccatcctggagaatggtgtggccaatgacattgccaatgaccaaagtaacggccataccaatggccacgctaacggttacacgaacggtcatgtaaatgctcatacaaagggagacccaaatggcaacgcaaccaatgactataatagccataatggaaattgaatttagcggccgcgaattcgcccttaggaggagccggaggagacccaatacgttttcacctggtctgcctctgattcaaacggaattgagcgactcggacagcatatgaaaattacctaactctaatcgaacctcaagtatgtctcagaagagtttctgcgggacctggcctacaccttatccaacaaacgaagtgttctgccatggaagactttcgcgttggcgggaaacctggaaagtctcaagacgcaggtacaaactctgccaaagcccgtgcggtcgtccacaagtccgcggataaactttgtctttacaggccaaggtgcgcagtgggctcgaatggggattgagcttttgaagttcgagactttccggcaaagcattctaaaggcggactcctatctgaaaggactcgggaactcctggtcgctgatcgaagagcttcataaacctgcagattcttctcagattgatagcccggcgttagcacagccgctatgtacagctctgcaggtagcactggtggagctcctcgaaggatggggagtggttccctggggcgtggtgggccattcgtcgggagagattgctgctgcattttgcgcaggagcaatttctcgtgaatcagcatggacaattgcctacttccgtggagcactggctgctcgggtagcagagtctaaaactggcgaacgtggagctatgatggctgtgggcctaactgcctctgaactccagcctcatatagatgagatctcggccgtccatggtcaacaatgcctgtcaattggttgcatcaacagcgccaacaatataaccgcgacagggttggataagtctatcgacgccctcaaggtccgcctagatgagaagaaggtgtttgcccgcaagttgaaaattccagttgcctaccattcttctcacatgcaagtgattgctgaagaatacaagagccttttgcagggtatttgccaaccaaggcagtctcctcggaaaggcgaaacacctgttttttgctcatcagtcacaggacaacctgtcccagtcaaacagctctctctgccccaatactgggtcaagaaccttgtgtcgactgtcaggttttccgaagctcttggacaattgtcccaagccagccgcaattcggggtctaacacgcaagtggatcactatgttgagatcggcccacatgcagctatgcaaagagcggtcatggacaatgtgcctcaatctgaaaacgtcaaatatgactcagcgatgcggcgaggtgtctcaggactgaaatccttgcagcagctctccggaaagctttggaccgagggatacccagtcaaaattgaagctgtcaacagctatgggtcgaaccgatcggcgaaaatggtagtagatctaccagaatacccgttcaaccattcacagacatactggctcgagagtcgactgttcaagaattacagaactcgcgacaatattcgacacgagctagtcggcattcccacgaatgactggaatccgcttgagccgaagtttcgcttcaccatccgggtatccgaccttccatggctcacggaccatcgggtgagtaccaactgatcactatctgtaaagagcattctgctaactgaactgtagttgaatggatccccggtctatcctgctgcgggaatggcagttatggctatagaggctgcgaggcatctagccaagccagggcatgcagttagaggataccgcctgcgaaacataaggatcttctctgctttagtcgtccctgagactcctgaaggggtagaaagccagatcttcctgcgtaatgcagagaatagtcgaaccactggtgttcagacaattgaatgcagagagttcaatgtgtatgtgtactcagacaatgaatggcgggaagtctgcgctggatctgtcgtgacggaatatgaagagacgcccgacgaagtgtacggagaagacgagcgaagcctgacaaaggactattatcagtcgatgtaccaacaagcccttgaccgctgttcagcgacgagtactcagcaggttttctatgatgctggtcacaagatcgggtatggttttggtcccctattcaatactctccacgacctagcctacgatccggaaggggaccaagctgtggccgtcgttaaacctgatgagtggagaggtaaagttcccgagaagaactctcaggttcagccgcatatcattcaccccacagccttggacggggtgttccaagttacggcagtggcgaccaccaaaggtggaacacagcttggtccattacaggcaccgactcaattgcgagacttctggatctcacatgatctcatcgagcgcaaaccatccacaaagttgaatattctggcgcagacgacgctgcaagcagctcgagaaaccgactcgttcattcttgccatcaattcggagacgggagaaccagccattgtgatagacggctatcgggtgacaactgtgtccagccttagctacaaaccatccgagaaacgcaacatcttttacaggcttgattggaagcctgatgttgaccttattagtagctcacagacagagacttactgcttggacaaggagacaatgcccgtggaatggaagccttccaaaaatgtggtgacactgcactacatgtcggaaatgttgaaggagctggacgcccaaggctacgagactacctccccatacttccagagatacttggcctgggtgcggtaccatttcgatcttctgggtgagagcaatcctctccttcaatcaccatggaaagatacattcgcggatgacagttgccgcatgcagtacttggcggatttcgcagcaacaggcccggttgagggtgcggttaactcgttctgcaagcacctcgccgcgattgtccgcgaagaagtggatccgttagacctcctgttcaatcaaggcttggcgaaagacctgtacaaggacgagatcttcgtaattaccgccaagcggatggcggtgttcatggatctccttgcgcacaagaattccaagcttgatatccttgagatcggtgctggtactggaagtggtacccaacaaattctgtcggccttgggcaagcagggtaacgacaaaggcgtgactcccagataccaatcctacaccttcaccgatatttctcccgggttctttgaaaaggccaaggctaagttttccgatcatgttgatcgcatgactttccagacactggatatcgagcgagacccagctgcacagggattcacaccgggtggatacgatgtcgtgattgctgccactgtgctgcatgctacacaaagtatcagtgatactctgagtcatgcccgctccttactgaagccaggcggctacatcatcctcatggaaccaaccaacaaacatgacacagtgctaaatggcatttggggaacacttccaggatggtggagatcaacggaggtggaccggaagtggtgcccactgtattctcgggatgaatgggattattacctaaaacagaccggatacaccggggtggaaatggcaatcactgacttcccagatgtcgagaaccataccctcagcttcctcctctctcgagcatctcatgaggaatcaaaccagcttcaacttccggagtcgctctttattgctgccgaaactgagtttcagctcaaggttgcgggagaaattgcttcctacatctcctctacgttcgggaagaaatgcgacatcctcacgcctgatgctatctccgagcagatttcacagtcgaatgtttgtctctcactgcttgacctggggcgtccattcctagcggcaatgagtgggaaagattttgctcgcttcaagagacttgtggacttctcaagtcacatctactggataacgtccggtgcagatggaaacgctccactgccagaaaacgcaatgagttccggatttagccgagcggccatgcttgagaagcctggtctctactgggccaatttggacattcaggacatagcctgcgcaggcaaagcaatttcgagggttcttcagcgctcatatggggtgtctggagttgaaaattgggagggtgattatcttgaggccagcgacgtgacactcatccctcgagtggtagaagccaatgatatcaatgattatgtatattctcagactggcaaccgggacatcgagcgaaggcagcttggaagggagccaacggaggctctagaaattcaattttctcctgggcagcttggcagtttccggtacgccagggatgaaactccaagtaagcccctctcggaagacgaggtggaggtggcagtcaaggccacgggagtcaactttgccgacgtgatgtgcgtgcttggacagatcacagactcttacattggacatgagtatgggggtgtggtccgccgagttggttcagcagtgaaagatctggcccccggggatcgcgtttgcggtatggcatctgggacattcaagacgttcgtccggaacaaagtccacaccaccattcctattccggatcatatcgcattcaccgatgccttcccagcggtgtggctgacagcgctgtacggtatcacgcacctgggccgccttcgtaaaggcgagtctgtactcatacacgcagccgcgggcgctgtcggacaggctgccatccagctggcacagaatattggggcggatgtgtttgttacggtgagttcgtcggtcaagaagaatcttctgcaagagcgttacggaatccctggcgaccgtttcttctctagccgcaaattggcatttgggaagcagatcctgcgcgcaaccaacggtcgcggtgtcgatgtcgtcctcaactcaagctcaggtgaggcgctcgcagagacctggaggtgtgtcgcgcctttgggacggttcgttgagattggaaagcgagacatctactctttccagaagcttgccatgtctcaattctccaagaacgtcacattctcatcgctcgacctacagacggtatacaagaaccatccgtcagttattaaacaattgatggatgagctacatgagctgctttttgcaaagaaactgggtcctcctcacccggtaacacagttttcgcgcggagaatttgagtcggcctttcgctacctccagacaggccgtcatatgggcaaggcagtcatcaattgggaggaagaggctgaagtctcggtagttcccagtaatgatccggaatatgtcttcaactctcaggccagttatatcattgctggtggcctgggcggtatcggccggagtctctcgaggtggctttccactcgaggggtcaagcatttgatcttactgtcacgctcgggcgcagtttctgatgatgctattgagctagtcagtgagcttacagaaagaggtgtcaacgttatcactcccaagtgcgacgtcagcaacgcggattctctggcgagcgcactcagtgattgcgagcggacaatgccccgagtcaagggagtcatccaggcctccatggtactcaaggtatgttaactgagtctatttatcgtcgcatgggtgtaccagctgacactttgcaggaccgattgtttgacaacatgtctctggctgaatggcaggcagtgctcgaccccaagattgctggaacatggaaccttcatcaccatcttccagctgacatggactttttcgtcatcttgtcgtctctgggaggtatgattggatcaagaggccagtcccagtacaatgccgctgcgacattccaggatgcatttgctcgccatagatgggcacacggccagaagtgcatatctattgatgtcggactactcacgtccgtcggctacgtagcggaacaaaaggatgtgtcagagagatgggtcaacgccggtttcgatgccctttccgagaaggagcttcacagtgttgtggactgggcctgcaatcctcgcctgaacgtgtcatcaggatgggagactcaggtcctcacagccctcaaccggcccatggccatgatcaagcaaggcaaagaactgctgccttacatgaagcggaccatgtaccgacatctgcaccggacggaccagagcaccactgcgtccgcccctacctctgctcaggctgtagactacggggctctgctcggggatgctgataatgtagaagaagcaggagccattattgccacggctctggctcagagactctcgcaagctctctcagtaccggaggaggatgttgatatcaataggcctgctcattccttcggtgtggactcactggtggccgtcgagctgcggttctggttcgcgaatgagatgaaggctgagctctcggtcttcaatattttggcggactgtagcattcgggagttgggtcagcaagcggctggcaagagtcattatgtgcagaagaggcaggagaactaagaatacctgtcatttgtaatttagtatatggtcgttagattacatcaaatcgttacgaaactcaatttcgaatgatcatccctaatctttcctgaacagttgggctgtcagcactaatccttgcagtggctccaatagtaaagatgactgggtgctgcttgctgcctaccatgcaaggtaacactgctactgctatagtgtgacactgtaagcgggtcctgtcggaatgtgcctgcgtgtctgatagactaaactcaatggcccctcatttccccagccttactcagattcactagacttaaagacggcaagcccccctggcaggcgctggcgcctcccagattgtcttaaaagccatccgagcgatcatcgcttcttatttccttgtgcgaaggcaaatagcaaagactccggacctatagtcggttcagtcagcatcgttcagttcaaagaatgacaaacgaaaaacaaacctggtttattacaggctgctccagtggcttcggggaacagtttgtacgccaacttcgcgaacggggtgacaacgtcgtcgccacaggccggaatgctgagagcaaacttgcgcacctgaaggataccggtgccactatccttgaactcgatgttacggcacctcaggaagagctgaacgcgaagtttcagcaggccatcgatatctatgggggagtcgatgtactcgtgaacaacgcggggtacattcaatgcggggctatcgaggagctcacgtgagttttggcctgaggacttcaagtctttttgtttgataattacatttgggaaggatatgtttgactgactgagacgttagaccggaggatatgaaacgatccctcgacactaacttccatgggcctatcaacctgacccgcgctgcattgccgcattttcgcagcaagggtgagaagggtcaaggtatgatcatttacatgggatcgcagtctggtttttggggagagccagctgcatccgcgtactgtgccagtaaatttgctttagaaggtatgttttaccagtctgtccatctgctcctacacgacgaagctgacagtaaaactctttcccaccacaggagccgttgaaagcctctcgaaagagctaggctggcttgcaccaggcattaaacccctcattatagaagcaggcatcttcagcactgaagtcatgaggaatatcaaccatgttccttaccgagtcgatttctaccggggccttaacgacgcgtgtcgcgtgcgcggagaaggcaactaccgcaacccaccgggcaatgccgtggatttgattgccaagatcatccagattgcgaagggagagggtattgcagagggcaaagagatcccattgcgtgtgccgtttggtagtgattctcttggattccttaaggagaaggcgcgggatatgatgcgcattgcagaggaagggaagagattgcccgcaaagggcgaattcgcggccgctaaattcaagctgtttattacgatgggtaaagagataatcaaacaggcgtggctgacgcgtttttaccagctttgccatcgcaatagtggcgtacacatcagccatcgcatcgtgggcgttgctatgttcaataccattcgctttggttaaatgctcaaggcgaaagctcggtagaccgtcatcattttcaggccagtttattccttccgggcgcagggcataacaggcacgcataacatccagtaaatcccagcgcgagttatcatgctgccagctccaggcgtaaggatcgtagaaattacgataaaaaatgttgcgtgtgacttcgtcgtcgaaacgcacattgttgtagcccagaatacaggtcttcggtacggtaaaaagcgagtgaatacgggcggcaaacgcggcttcgttttctcctttcgcccgtgcttcctgcggggtaataccggtaattaatacggctcctggctggggtaaatagtcatcagcgggcttgcagtaaaagacttcgggttcgccgatgacattgaattcgcccttgaaatgacgatcatcactaccgctttggcatatatattgcccctctcgccaccgagatgcaacccccactaatcactttcataccacagaatccacacaatgcatctctctacgctgttcctaacgttcctaaccctctcacccaccctctcccaaccaacatcacccatatccgtcacccaactcttcaacttcagcatctccactgacatcgaaaacggcgccatcgaccctgttactaacactcttctcataaccaccttcaccgacgcccgtctctacgctctcgacctcaatgacccccaccccaccgccaacctcctcacctccttctaccccaacgccaccgccatcactggcatagcccccatcggccacggcaagtacgccatcaccggcggcgtccgcggcagctaccactactacaatgaaactatctacaccatagactttggggcctacgcagccaatgccactgcttccccggtcaccaaagcagtcgcgcatctcccgcaggcgatcatgctcaatggcctcgcttctctcccacgccatcccaccactgtcctagcagcggattcccgtgtggggtgtattttccgcatcgacacgctgaccggaacctcggacatcgttgtccagagcgacgcattgtcggctccggcgaatgggtcatcggagatcgggattaatggattgaagacacacggggagtatgcgtattataccaatactgcgttgaaaacttttggaagagtgaagattaccgatgatggtactgcggtgcctgggaaagatggcaaggttgaggtggaagttcttgccacgttgaaccccggaaaggaggaataccagtgggatgacttcgatttcgataaggaggggacagcgtatgtggctatggcagggtcgggtggtagggcaatcggaacgattagtcctgatggtgatgtcgaggtgttgtttactaaggtgatccgtgggccgacttcggtgcatgttgttgaaaaggaggggatgaggaagaagttgtatatcactactaatgggaacggtggacaggttgtggaggcggtgctctgaatggagtcaggtacataatgtgccacttagagtggcttagctttgtggttgaccgtttctgtttgaaggacaactgaagaggttgaattaggtatcgattctctggttgagggctggctttgtttctgtccgtattcactgactcacgatttgaccccggcgaatgggcaaacatgttgctcccccagatatctccctaactgaaagtttaagacagggcaataatcaaacagtcaatagccctcacatgtcacattgttccgacatatattaaagccgaggagacgaaatgaagtcaggttgtcaggatcccattctggtgcgcttcaggagtgaatcctccggatctaaattgataggttatctggtaacgttaaaagattagaattctgaatcaacagagtcagaatgcgcatgtattatgagcttaggtgaatgtgaccgtcacaatagtctgtatctttgagtaacatgataaatgttaaaagcctgtttgaggtccatatcccagcatgatagttgtaaacaaacccgataatgcctattacatacgcctagcacaatgaaggctatcgttataaatggcccagattaagttactcccggaagactttatgtcaagcatgcaaggttaagcagggagtaaaacagtatgtcgggtaaaacgatgatgaatggctgctcgcaagcgttcatacagaccattacgaaataatttagcattgtgttttatttcaatctattactgtcgctttctttcgtgtcatattgggatttttatttgttgatgtggtgaaatggcattccaggctaagttctatttattgaatagcaccgaattgaattgctcaaccgactattggtgaattacttctgtagtccgctacttctcacctttcgtataagctagtacaggggtaaaacttcttctttcccatgactatcactactttgatgaaattcatcctagccaagtatccttactcgaagctttgtcattgtccctacccgaagatgttttctggaatcttgaagggcatcgccttactaattctcatcctgtttgttcgcttcaaatatactcactcctttctgcacaagacaacgatcttcaagacacctaagcaatgtcatatgatcatcgccgcagatggccagttctttgacaaaagaaacctgttgtcgccctacgaggctcgcacattttccaactcccgattcaaatcagctttctgcatccaaaatgcgttcacgagctctgaccaagactttgtgaacgagcatgtgaaaaatatcaaggtgctcataaatctgactcctctggagtggaatcatctgtcccagtctctccagcagactgcccgctattgggtcaactcatcagagggcacagtccacttggccggcattactcagactctttctctgcggttggtattggtgggggtatgcaagctagattccaggatctcagtttctgaagacccctactttgctgactttgcacgatgtatcaacaaatcttggattttagcaaaagggcctgatattcttccctttgaagacaatgaagagctacaagactatatcggtattttctttccttcatgtggtccaattcagcctgaagaaaatccgttgaatgtgatccttccgggctatgagactagttggagagtggcattacgaatgttcctcgagattaggcgtgctgaaaaccaagtttgggttgataagatggtgagctttgcccttcaccctacaaaagtacagttccaggacaatagcgacggcatttctgccgaagcattgctctctgaggcccttcgtctgtatccacctacccgacgcatccgtcgcacgttccgctttgaaaatggcaggaatggtgcagttgatgaagacacattcgcagcagatattgaggcctgtcatttggacaaaagtatctggggaacagacgctctggaatataagccttcgcgatttgctacattgaccgatgaacagaaggaagcttacatgcccttcggcagttccccattcttatgtcccgcgaagcctgtctttgggcctaggatgatcgggatggtggtcgggatcctgttctttgcattgcaggaggtagggagctggaggctagttggaagggatacacactctgctaatggctatgtgtctggtgagcgattgaacaacgaccgcggtgcatttgatgatttattactgtatctgaatactaaatgaggaaaaggaaggctgagttggttcggagaatttctgccccacttagtctcactggaacggtgttacagatcttgggcacataaaatattcttgtgccgggctttcaatttgggatcttggaatctgcctgatcttcttgtccattctgatactaatgaaacaatttttgatcaagacggcccccaataactaagatccgcatatccgatggagcatggctgcttatggagggcaatagcggccattgggcaaaaccaatttcttgaagcttattgcccatatgaggagtatgaagtcggtttggaatgcgtagcttatctaacatatctatttaatgacgttgtacatatatcattagatgatttgcttagttttgctgtatagacagctactggttccaagcattatgaaggaaaataagtcctacccaggatattatacaaggtactttaaactactaaggtgcatattaatgtggataagtcgaaggtcgagattttatatctagctagagaagagtgggatcatcataattcccggtctcttaagaataattaaatagctggtattctgtccctctatattctcaaataaggagtattatatacagagtcttctaccaaagccctgccttatatagtagtaatatatatattctttttaacatttgtccaaacataactctgtaagcagtgacatgctgccctattcgactatttacgattagcagataatggacaacttccacgggattggatgatgcaggtattattatatgggagccggcgagacttaagctgctgagctgtgatccagccacgtcagaattcaacatcttggccagggatggcagccaccgctctctgtacatcattgtgcgcttgttgagtcaccgatggccagtaactagacaactcaaatttgatgaaagctcaagacaagcaaagcaggcagaaagatactatacgacatctgcaactttgttagtgcaaagtcgttagtcctataatgcctctaatcaaatgttcctccagcccctgtcataggagatgagtcgggcagctgactcacgagatcttggcgaaatggacaatatggacaggatttttagcatcctacgtactctgcaaaagtgtcaagaggttgtagaaagcaaaaaaaatatttaacagataagtaaattgttgcaagaagcctcttggaaatggtttgctggctttccaatacagtcgaatttggagacgtcatcattagtgtgatgagtccacaggtttctcaaatactaatagagagcatccttctgtaccgcacggcattcttagcttcggctattgctgatacctcctagtcacctgtagatcgcaatgcaccgtccgtatatgcctacattggccgagtgttcatattgtttttgtctgcttgtattttgtccccgtttgaatgctataaacagggaaagcaccggcaccgaataagatacttggggcacgcaaggctttattgcatgaaatatgtcgatatggggtggcaatgaatagggttcagagatatcattttaccagggggccacagtcgtacccatagcagattgtattccaaagagaaggtatttatttcagacatcccgcgataactcgatgtaacgaaattgtagataaattgagacagtatgacgtatatagcatgcagaggctaaaaagaacaacaaggtaattgaattcaaatccagagtacaagcttgtcaatcatagacattttaatggtacattgtacttgatataagcctataaacccgtctctgccaagactattcgccttctagccgtcggaaggacatgaaggggcaattggtatttttttttaatttgacatcatttgccacgccgaaagcttttattactgagactaaccagaacggtagggatagatcaggctggtacaaaatcttagaattgcacgcatgatggttgcaataaactagcaaagcgatactagaagtagaacggtgaggtgtatgagaccacgggtcatcatgcccactagtgcctagtacatttgatggaaatatgtatacatctctcacctacccactggtatggaggcaactccagttcctctcttctgcaggcgcgcagatacgtgtggtactcgttctaaatcaacagttagtttgcttttagcattcaactggattgatttgattatattgattggttcaaagacatcctgggcggcctggtggttagtgcggaagaggaagaggtggtgataatggtaagtaaacaggtcaggcgagctttatgttagttatatatcgcgtggcccctaaaagtttagcgcgggtctgacgagactgaagtatccttatgctcctggaattttgccgacgctgtaggtaataatggcagtgataattaattattgatgaaatggagccagctctaattcatctctacctcaatgaataaaacttgctgatttatgacttggcctgataagcatcttatgttgccaatttttagacggatgagcgatgacggcgtctctgtgaaccttccttgacttaaacggaataagctgtttcaagtcctacgatcaatcataatcaatctcaatttgcgaagagggcttgccaagaagcatggagcgtgacaatgacaaccccgaccacatgcgattatctctgactacctctgacctcgagccgataaaccttgtctttcacctacaggagcaggaccatgatcaacaaattagagtcatcttcgataataaacatactacgcattctatgatttatatacaaatgccgaagcaagcttgtgctctttggcataagctagaagtatggaaaatcggtcggcactccatcccttaggtcccgccacccagagataagacgatctcttctgtatgtactcaagggtcagataccatgaacgtcgcctcaaagttctcagatctcgtcttttcttatagatccaaccgactcgataggctcatttttataatctcaatggcagcaatgatgatctttgcaagatcgacaacgcaaacaggatcttcagcatcatatgggccaaatgtctctaaaacaagaaatttatcagttgcttcattattcttgagatacctctcaagttcctcctcatatttggcaaatgtcaagaatatctggtgccgattctgggacataaggagaaaactgcatgaaaatcaagtgtcagctacttgctgaagaagccttctcttgagagctgacttactggcctcgaaatacagctgactttggagacgtcatcatccatgcaataagctcacaagcttcttggatgataaaggagcgcgaccggagacccttcttaacttcggcgatagaaaagacctcaaaatcacttgtagagcgcaacgctccatctgtgaaggcgcaatatcgtcgcttatcgccaaaatcggcaagaaagccagtcctattcagcacccactcaaggtctgtgcgttctactatgtgcgtaatctcttgaagcaaaacgataagcgccgcatttggcgttgcttcatcctccgcatctcggaatttttcgaccttctgattgctggctcgtctgactcggtcgtgcgttccttgtactgtggctgtttgctcctgcagccgcttggcagccatgaatgatccgggccaaaggtcaccttgtatttccctgagttcccggatagatatgcctcgctcaagaatccggatgtatttgtcccagtcccgggattgatggagcagattctctgcctggctcagcaggtgatcactgaatccaaacttgttcatgtggttaccgaattcgatgttagatacaattcgaggcgaataacagcgtagcattagatattgtttattggacgcttttgaagctgagccgaacattccgcttggcaaggttttgatagttaaattttccaaacgtcctgcctgcacaagagcctcccatttctgaggatcagttggtaccttgaatccttcaatcttccccagttcttttgcggactttttcttcgcttgctcctcctggtttggaggactggcctgttttcgattcgcggccttcttggccttggccttctgaagaagttccattttcagacaggattttaagagataagcgaggactctgcacaaggaaaagcagctgcgcaagagagccaatattgtgaaaatgttagatgtagaagattgcgtccaagtgtgggagttgtgtgccgaatctaggtgttttctgtttgctgtgacttcagtcgtgttgtacagacccactagagtactagagaggaaagaaattacgatgcactgtctattagaaaacatatcatcaagaactgagctaggacaatagtgagatttattcagactagcgaaatgcggagaggtaggagaccgaatgtccttctgcaagaccatgcaggtattaatataagctgtccctacggcgaatgaaaagagggtggacggtttcctcggcttgggcaatggatcactatcaggccgatacattgccctgtaatcagggggaatcagccatcgtcacggcggggccaagccaatggacgggcacattgcctagtattatctcttggatatggctggtagtctagtcttgtagaggagaaagcaacaaacgcaggtgactatttggtagtaggatgttgtcaaatctcgtgttttcttttctcattcaagtctctttacatgcaatttcatatctgattagccccatggacccagtttcctcgggtacgatagtactaagaagttggtgagaagccaaagatgataggtactacccagccgcacttgctccgcacccaagagtcccgtcttaactatcagtgtttcggggatttttgatatccggaatgggagatttaaacaggtcacaggcacctcgccagaaagatcccacccttaatgatatcaactctctgctcctgatttcccgacctggattgtcgcccgggagtggagggactgcagcccctggctgtaaagacctgttagttcctcacctaaaaaaagaaaaactgtcatagtcaaatgagaacctactttggtcatgatgtgcggatccatcgtgttcccgatcattctggagcacataaaactcgccaggatgtccatgctcgcaatggctgcatctccgttcacgaagctaaggaaatcggactttcgaatgacgagccctctataatcatagtgggcctccagaattctgagcttgaatccgggaaagacgcttatgaccattacctaggttttgagtgagtttcaagagtttttcgaagaacaatgactggaagccgacccgaagatcccacttacaggaatgacattgtggttgagacattcatcaccctcaagcctagacaacatcaccgtcaagatgactactgcctcgtatctggaaagcctctcatctgcgtcagactttgtaagcgttgcgagcagggtgtggggccggttgagctgattcctagctatataaccgaagtatagcattgacccacgcgatccgtaaagtgggccttcgaattcttcggcgacgagctccggtataatatccccgcttgagataggtttgtcagctccagaacagttttcaaagttgtacacacccatggtttccccgggcagaaaatgctcaccattcgatccactttgcgtaatccgacagcgtattcgaccacccatactctgattcataatcgcgtgcgcttgtacaaagaatgttttcaatacggtacatcaacatatagatttgatctgtcaccgttggtggtcgcggggtgggtttgtcccaattttcgaagatctccttgacaagcttttggccctgatcttgcgtagggtgaggttgggggacattatgcgttccaagaggttcaaaaaagactggcgagagctcatcctgattagttcctcttttcgagatgtgcaaatcctcacaaatgacaccgagagtttcttgaatattaggctcaatccacgcggcttcatggttcgcaactgcttcgaaggtctcactcattttatttatcacaagggcgcgtacttcttggtgcctgacttggtcttgggtagaacgaccgaacaagaaacgaaggtgtccagccattttgtcgtaattgctggtttcggatctgtctttggctaagggaaagatatatcagcttggactttgggttcaagagggcgtcacgaagacaaggaataatctaatgatttcatttaagaatgagggggctgggaggttcagattttggcaataggaggtgaatgctcactgtcacataataagcacattgtgcaacaacgcattggtgtcacccaaaccaataaaggtgggctccggataggaggtatcagtcactgttagtagagtccaacaactgagaatgctgtcacaaatctgaagaagaggtgatagtcacagacttcgacctctccaacgggcctaccatcctaataaataccaatttaaagtaaccatgggtggcggaatgacccatagttctgtcaatggccttgcaccatttttacatggggagccaatgcatgagagcttcggcaaagctcatcgttcccagaacacgaagagaatatgtgaatagaatttgtcaactatctgtcaatctctcccactcagatactgtggaactacccttctaaatgcgttaacaattcacaatggggattaatgattaactaacggactggacacagatagtaagaacttccaaacctaaatgtcaatgcggagaaaaccccgaaagtcgtacggattcccccgcgcgccgggaatctttccgacctccaacgaattttcctcggtctctcccagacattgaatacgatcaaggccaaacgatttaaacgccatgaaaaagtcgcagctactacgattgaccacagattaacctttcattttctagtggccatatttatccatacaacaaaatggaataccaacgcctcggcaaaagcggcctcaagacctccaaaatcatcctcggatgcatgacctttggcaatcccgcatgggaaggcagtccctgggtgctcccccaagacgaagcgctccccttactcaaaaaagcctttgacaacgggatcaacacttgggacacagcgaacacttactctaacgggacatcagagatcctaatcggaaaagccttaaataaatacaacatcccgcgaagcagggtagtgattatgacgaagctatactatccagtcttcgaccctgattccccatcgagacctaatcccgccatcaacgacggtgagctagtgaatcaaatgggcctaagtcgaaaacacatcttcgacgcggttgaagggtcactcgcgcgcctgaacacgacgtatatcgatgttctgcaactacaccgactggacgatacagaagcagaggaaatcatgtgtgcactgcatgatctcgtccgaatgggcaaggttcattatctgggtgcgtcaagcatgtactgttggcagctggcgaggttgcagtatgcagcgaagatgaataattggacgacgtttactagtatgcaggggctttggaacttgctttatcgggaggaggagcgagaggttaatgcgttttgcagggctgaggggattgggttgattccttggagtccattggctcgtgggttgttggctaggccgtggaatgcgcagacgtatcggtctagtcaggataaaaagacggttaagtggttctcagggacacagaatgaggttattgtttcacgggtggagcagttggcgaaatcgaaagggtgcagtatgagtgctattgctattgcgtggttgttgaagaagggggcgtgtccgattgtcgggttgaatagcatggagaggatagagtcggcggccgaggcattgggtgttcaattgtccgatgaagatgttaggttacttgaggaagagtatagacttcttcctgtcgaggctatatagttacattagatgaaggggtgtttatagtctgcgcgccttgttaggaccgatatacaggtagaccgtccttgttattgtgtgccgatacaagaagtgggaaggtattacgagctttttggacatataaatcattgtaatcaattttaaataccgagcttctgtctaacatagctatggcatgaaattcgacaccaaatctggaaaggtaaattctcccatatccgtaaacaagaaatcgtcaactggagcctcactcgaacccaacggaaaaatattgttcatagaccccaaggtctgagttgagggtccaggacctccatgtaattcccgcatgctgaacagtagtagacaaagtgttgccagtatggctattttcggacagactacccagtcccagcatagtgaccgtctcggagagctttcgattcagcccaggagccatccggcggagtgggtgatatgtaatgcaagctatgttgcgaaagacgcctaagaccgcattaatcagatgaagatctccaggtagatcaatgttcaattgcacatgatgattgtgacatatctccagtaacaagtgaccggcaaatgcgatcattacatggaaataatgtggcatgccgacgagattctcgctcatatggggatcatttaggatcatctcaaagatggtgaccgtcgcctcatgagccatgtgagccgcagacagaaagtgcatggggatagggttgccacggagccccttgaacacttgttggccaaggtagagtctcccaaactgatagtgcaactccagccctcttctcgggaattccccgatatgcgcatttgtgacgaagagggcagagaatcgagtgaaccatctgtcaagttgtcgagagtagttgctgatctgatgagtaagggccgatggcagctgcatctccttgtcagaccctagaacatctcgaacttgacccattattaatagcagcgacacctgcgacagaattcgtacgtctgactcagttgcctctactcgatgtaggtatgcctcccagctcaccgcaatgtccttatcgttccgcagaagagagtcgcgattatggaggatggagagatgctgatcgcagacgaataataggtaccatagacgaatgcgatctgccgcaactattggcgatgaggatgatggagaagaatactcgggcggatgagcgccaagaagagagtcgaaactgcgatggagacgcatatcggcggctcgacggatgccatcgctagacaagatccgcgatgcgtctgcgagccaaaaagacgcaatacataaggctcgtagatattcgacgtcacgcttttcaaagagagaccgcgcgacctgggagcgaaactcgcggttacacgcttcgtatgtttcctggtcgtgagggtcatggagggctgacacagtgcatatggcagtgagcagggtcggcgaatccttgcgtagatggtctaagtcccgattctcaccacagatcccatagagaaaatgatctaggcgggagtagtagcggcgcagtagttgttctgccgtttcaagggtgatgatgcctttactaatgagatccgctcgcccattggcgcgagtgacacctggtggaatcttggcggagtttggggtcccatgtttggcgatgtccaggaatgtatcaataggagcctgcaccgcagtgggggactctggtggggatacttcgcatccttccgttggaccagcgtcacattcaccgtctagcctgatgctttctccggcggctctttgctcattccctgaaattaaaaggggccttgggcgttgaatatctaaatgctggcagatgtagtcgatggtttgatgcagattctgtacatcggtgcgcaaatgctcgacatttctgcaaagcgtacatattagcctaatatgttcggatcgaatagagagacaacccacttggtatcttcaacgagagactgaagactccgattcagcacacaagataatgatcgccggcgacatcgaacgcaaggtggaccattttctggcatatcacattttgtctgtcggcttggatattagattgagcaatggaatctcttgacaccgaagtttcaccttgtttttccgacaggctacacatgcagtgacctttcgggtgatactaggcaagacattgaccagcgatggtactgctgcaggttgttgcgggcttctctccgactcttgacaggaaggcgattcagaccgaccgggatattccagggtgccttgctgctgtcgggagctggccgaagctggcgtgagggagcgagcgatctcttccctgtggctgtccgcttccgttgtggatgccggtcgcttgcgcttgaccatcttgaattgtcgtgcttttgatatcgcaaacatttcatttgtctgatgtttgtaaacgttgttgggcggtcagtttgcttaccccgcattgtcggttattgtccatcccggtcttgtcgggagaagcccgagtgtttggtatatagacactagcagtttccagtaccgaacaatatgtcgagtcacaaccatgacttcagcagttccaccaaagagcaaaccgctgcctccgggcatatattgcccagtaatctctctgttcaaagggacaccgcggcaggagatcgactacgatgcttcatacaagttcttcactcatctcatccggagtgggatccacggaatcgtcctcgctggcacaaatgccgaggcggttctgctttcaccaactgagcgacaggagttggtgagaactgctcgacgggcggctgtggatttgggatttgatgattatcctgtggtggcgggaattagtgggcaatcaacgaacgagtctcttcgcctcgccgaagacgctcgtgaggcaggagcagactttgggctacttctgccgcccagctactggcctaaagcagtcacgaaagacgtcattctggacttttacactgaggttgcagacagcaaccttctcccaatcgtcatctacagcgtaagccctctttccacatatgatgcatgcatgaactttggctgaattaagaccatagtttcctgctgtctgcaatggcgtggacatgaactcggatgtcatgtcagccttggctcagcatcccaacattgtcggggtcaaattgacatgtggtaatgctggcaaggttactcggttaactcaggaatatacacatgaacaatttggggtatatgctggctcatctgactggctcatcccttgtctcagcgggggcggatcaggttgcgtgacaggaattgccaatgttttcccaaagtcaaccgccaagctattctctctgtggaaggctgggcagattgaagaagcgcgaaagttacagggtctgatatcacaggccgaaaaggcctgcaaggaaggaattgcgcctaccaaatttgccgcggcacactttgccggacccgtcgcaggagtgacggaccaagcagcattcctccctcgaaagccgtataaagcgtcatcaccggcaacgcgggaatgggtaatcggtgtgatgaagcatcttgtggatattgagaattctttgccagatgtgcgagcggagtgaacatatatgttacaatagaaagatcctattttatatctctatactttttcattccactgaggatgccatgactatataggagtagatgtaaatagtggagtacagtctcgtctatgtagtctcttcctagatctctacgaaaacctcgtcaaaaatttctcattagaggaagtacctcgaatagttcctcgaacgagcttgaagtgtattgctctaatctatggttgcatctaattgacaggagcggcaacaccggtaaaaatctccttcatacctgattcgtcatatatattgattcttcaggcgaaccatacaagtggtttgattggcgacacagtgttggcaccactggtggtacttggattgactccagcggccccaagggtattctacgaactctgcccaacatgtacgcatttaccattccggatctccagtccggtcagcctggtcagacacaacgatcggtcatagctctgtctcagaatcggattcatctttggaggcaggcgcatgcaaatggagacactctcatccgcagaagggttggcatgtcaagtggtactgaacttgatacactgtcaggttatttgcctataggtctgattcacgaacttatccacgccaagcatgtggttggactgcgaatcacgagtacttaatccttatattgacccgtcttgaggatgtacacgagcgttaatctttttttgaattacagttgaccagaaatgcactctgactggtgacagtgcatacgggtggaaaagcattactcatttagccaaaagggatccgacaaaatcggtcttaaatgtaggtaggttcagcagataccgcaccttactattgcaggatattatagatactgagtcaaattggaacagatagcatcgcgttgtatgcgctgggtgagtctcccctttccaaaggacatctgcacactagagaatatattgcgaatattgttactaatgatagcttgtacaattagctatgtttctggatagccttgattggtccagtggggaagcagtagctctcctcactcaacatagcaatcaggattgtgagatggcttttgggccacaggaagagtcgacatcaagcagtgacggtagcaatattggctggtacactaccatttgatgtcaaactttggtaaataaccggtgagaagagtggaatagaattggctcctaagtcaagatcaattctcaatcagtagcagtccggtagtcatatcgagccatgctccatggacgattactgcaaatgtatatatctcatttcacaacagatggcctgttgagctttgtcattccctcatgtaccgccagtggactagagctatgtatagaatactaaagagtgccggaacacaagaatcacggcaatgaacatgaaattgctaccagaagccatagataaacaggaatgtattgaggttgacatacccctttatcaggccgtattattattagtgcgacaagaagttgcgacccatatactctgtagacggctaacagatacgatcgttttcataagcagtgatggatgttattcactgccgtggatattctgctagtggagaatggccgaatcctgtgtatattaagcgggggcctaccgtcacgcatcgtcacaacgtaactcttcttttcacttaatcctaataagttgtgattcggccattttcagcggcacggttaccttatccgctatcagaaaatggagtattatgtctccaacacgcaaatgcagtctcctcgtctatccggagtctcatggaccgagacgcgcctacatgatcaccttcccccaactcctgttctcagcttcataagattgacattccgaccggatgttaatattgtgaatgagacaaagatagggcattcactatggcaacagtcattggctctcatttctaccatacccggatttcagcgggtttactgggcttctatatctgatgaccccaatggagttgtcgttctaattcaatggcagagtggcgatgcatggaaagaattccaattttcatttggatttggcctcatgctgcctcttctacagcaaaagcccctcctgaattgctgtgttcagctcaaccttcctgctgatttcgccgcggggccaggacatattctagagctgatagaactctctgtcctccgcgcctcaaataagtatgatccagcggagagatgccagtgggtcaacgaggaatggcaaggattaattgaggttctcaaatctggagttttaggaataacatttccgaaactgctctgcggtgtgcagggctggctagaagatgatataccatctgaatatcgaacctttttcggtcttttactctggaaggtcccatgtgggcgtgcctcatggattcagactcccgctctgaataagaaaattctgattttaacctctcacagtgcaggaatatccactatactgacagatcgtctatttgaatacaaccccttgacaatgccaaccaaccagctagtatccgtcgaacgattttcgggcaccatattcgcgacccagatctcgccaccccagtacagtcgtgacaaggggtttgattacatcgctcggtgggacttgtggggtaaaagaagcgtcgatgaagctgcctccggtcgtcgtatctgtcctctccctagagcattctggtgcccgatgggcgccatgagcaaacacggatttccaacagttggtgatgtccttcctcgatctgcagtagtaccgatgattgatgtcttgtggttgtacgtcgatgagagttattctggtttttcggccaccctcggcaacctgtgtcgcgctattcataacaaactaggatcaccgcgtctccgatggggccgagaagccagcaaaattacccccgagcccaggacttccatgtttgcgatattgattggtaagctcgtaaatacagaggttcttctactggcagcccatgtgtgtgtctaacgcgctttcagaatgaaggattgtgccagataaaaataccttacaccagatcgaccagctggtagacgccgcagttatccaaggacgtggtgtgatccagagacgaggtccagaattagaccgctattgcgcttcgctttccatgaatcagcccagtcaactagaacttctgtcaatctccgtcccaaatgatgaatgccacaaggatatcttgtggcatgcctaccatagatttaaatggtaactatcaacgattctggatttgtcgcagataccatgcgtttcatcactctcccccgtatttttcttttcttctttccacttctccttccagcgtgtcttatttattcgccattcttcatctcgccttcattaaccaatatctacgccttccgctttcattgagaacctctggctaactatgctaaaaccacatccatacaggaccatgtcctcccctgctgtccaagagggtatatatgtgcgacaattacccactgcagccgccgagcccctccgccatggcttccacgaaattgtatctagtccgctacacagctcatctgcaaacacaattcgcttctctgctagtactgcttggttgagtgcggaggcccgtgaagaatggtacaccggttttgcggaccaagcaataagctgttacgaacgcctgggttatatcattgcttggtttcagactgtggcactggccgcggagtgctttgttattgacctggaaccaataggtcggacttttgatgattggtaaaagtcttcacagcctcaacaatccgaagcagtgcattaggacatgtcttcggacgcgacatttgcttcagtctttgtgaaacattcgaaagtattggggccagtagagaaatcgactaagtttactatctcattgttctactttgtagccacgaagatgacacttctatctgcggtgagataagtacgattccaagttgtgaagagcacggctgctactttgccagtcacacttcattcagccgcatagtagggactgaatcaggtcgaggagtaccaaatggctgctctacacgattcctaaaaatattgccactaaatatccgtgaaatagtctcaccattacaaaagcgaattcacaattaaaaactcgaaacattgtgttcgcatcgtctattctgcgtatctaagtccagtcggtatacttctaaagagcgtggcaaccatctagccgaaacctatccgaagaagtcctccttgaattggacatacttgatccgttgtcgccaaaaggtataagcaacgtggattattccctcagcacaaaccatgcttggatacgacagctcccggttgagctttttctcgctgttgttcgtcaagcaatacccatccccatcctccagtattcgatgcttccatgtcttccccttatcatcactccatgcaacacacaagggagcccgtggtgacccccaaaacgactccctgccatccttcgctgacgcctgattttttctttcgtctaccccgtcagcgatatcgtcatacaggccctgtctccttcccaaagcatcaagcttagatgaatgattatacaccaatactacccttccggacggtagcacatcaaagcaaatgcctgcatttggatttggaagcgacgtcggttgcggagcactccagactacaccgtctggcgaggtagccaggtagacgttgtcagcccagcgactgcgaaacatgcccaaatacgatccgtccttcagccgttggatctccatatgcacgcaccccgtgctttcagggatctccgattcagtccaggtgcgaccctgatcccttgatacccggatgcaggaaatatcatcatttcccaaccatcgctcccccggctgcacacgacacttgaagactggaactacccaagctccatcttcgaggacggccactggctgccggataaaggtaccggtatcgtgaaacaagaccttttcatcgccccatgtggcgccgctatcgtttgacacccgatacttgacaatggccgtatcctgatcaccagaatgttgggaggtgtaaagaagccatagctctccggtaggtgagtgaaagagaacaggattctgctcgctacgggtgtcgtcgtgggtcatcttcgacgcttccgtccactcgctctccccgcaccttagccgagagagatagatgctgatgtcgggctttccttctagactgcctccaaaccaggcacaaaacaggtcgccattcggcattcggagtagattggatgcatgactctgtaccgtgggcgcaggtaggtatgcctcgcggtagaagtagggtttctccacggaacggattaaactgtccgaagggaatgtggaagccattgtgaataagatccagcttgaccttcggtttgtgagtaagttcctcccagattctggccaagttgcgtgctcttattccaagtgctccaccattatgccataatcaaagaatattgattggccaatctccacaaaggacgcgcactcttcgggccagggccgacaagctctcaacgctcggaggacagtccgacgatcgcctgcagcgaacagcttggactgacctccgcatttaccccggattcagtgcagctgtcactatggggtgttgcagatcaccccaaaacagtccaagaggggccgtgatcatgcgtaacttccccgccatataatggagcgcattttcggccgcaaccaggatgtatctcatcctatgtggggagagtcgtatcttggctgccacactgaccaagggccaaaattactgttattgcatgttcaagtgcccaaacgtgttaccatttaattgttgctttaattctcaaattacatctcaatggctggaggtaccagcatctgggcaagccaggaggccagaacggatcccaggcaaatcttcaatggaagactagtctatcttctgatcactcttgcgtgggcaggctggttctatggatttgacacgggaaatatcgggggcatccttacattgccctcatttgaacatgcattcggactagacaagttgtccacggcagagcttgatagtcgaaaggtaaacttgcatacatctccaacataacgaaaattattgacaggtgtagggaaccatcgcagcgatgctcgcagccggtggctcagctggctctctctgtgcagccccaaccgccgacttcctaggccgcaagtggtctgtcttcctatggggatctgttttcgtcatcggtggtgtaatgcaaatgatcgccgactacaaagtactcattgccggtcgcttcatcggcgggatgggtgttggggccagttccatgctgtcgccacaatttctggcggagaactcaccaaaatcagtgagaggatcagcaacagccatgtacaacctgatgattctagcgggcttaatggtcgccttctggatcaactacggagtttccttgtggtcattccctggtgttgagcatgacaatactcaatggagaacggcaatggggatccaactgattcctggggtcttgatgtgcctgatgattccttttgttccagaaacgccgcgttatctgatcaaccatggaaaggaagagcagggactgaagaatctatgtcgactgaggaagctccctgctgaccatccttacatccagacggaatatcaggaaattgtagcccaggtcagattcgagcaagaatgccatcagggacacagctactgggtcgttcttcaagatatcattttcatcaaaagcaatgcccgacgattttttcttgcggttatgctgttcctcttccacaaattcactggcactgactctttgaatgtgagtgcggagagtctagcatcatccttgacacggagtatgctaacgcaacacacaatagtactatgcccctgagattttcgaactcatcggcgtcaacggaacgtcaaatagcctccttactacaggcgtctacggggtcgtcaaattcgtcgtaacgatcttctacgtcacctacctagtcgatcgtgtcggtcgtcgtcggccacttctcgtcggtgccgtcctccaggcaaccgccatgctctacctcgccctctacctccgcttcgcagggaccaataccagcaccgtcggcggaacaccagctggtggcattgtcggaatagtctggatttatatttatgcctttggatggtctttcggacacagtgtggcgtgctacattgtggcggccgaaatattcccgaccagaatcgtacgtacacattgcttagatctattgtgtatgtcttcgctaacggcctagcagagatcagtctgtatgggcttctgcttcttcgtcaactggatcgttgactatggtatcacccgagctacaccagacatgatcacgaacatggggtggggtgtgttcctcctgtatgctatgctaacttattctggcgtcgtgtttatatacttttgtctgccagaattaaaaggaaggtctatcgagagtatcgatgacttgttccagagaccattgtggactatgtggcgacatgcgtatccaaccgaagaagagaaagtgcggcagggaattccacaagtagctaaggggcagacgaatgatgaaggggataagcaatctgtggatcatgttgaacgtgtctagtttgttctattgtctataagcggttttcacgttctttatcggattctgattagggtgcctttcatgaagtcattttgatacagctgcgtcatactgttaagctgctttctatattctgctgaggtcgatacatgctatggagacgcctatcactagcctccagcaccttcatacaaaacttttcaacttgagacgctcctactcagacttttcaaaaacagagtttgaagcgcacgtcttagctttgttttctgttaacctctcctaaggctttaataattgcctggtgattttttgcggagtgggaattggtgacgtattagtcgatagtggtttatttgtccggcaacgaacaaaccagaaatgctgaaaagtacaagggaatatcgcagtactggaagagcctcttttcagcagactaaatctcatttctcaccactactaacacaggagtacagggtttcttccagcccaagtattcgaacaggatatgggggtctcaaatctgttgtgctataattttactataatctcaagccaattaagctgtatacttctataacacatgcttcaatgctgatataggcagatagtactgtttatcatacaacaacagatcagagaccccgaattctagttttatgaaaactaatctacactccaaactcaccctggaatccagagaactaccaactaacccacccagcttcgctccgcacgacatggccacactcgtagccctcccaggcgagcgaacccagaaattcatccggcgttttgactactttcacaattgagatatcacctatatcgccaacaagtacgccttattcagcatccttgttgttctttccagagtgtaaaattataaaatagctatcagtgcaaatccccagatagttctatcttgccgacctacttttctgtgggcttaactgagcatggctaaaccttgtcagttcatagccccctcttctgcctccttttgtgacagaaattagtgccgacgatcatctgacctaaaatatgacaagtacgttcattgccttctctgtctgcacctaaaatgtagtctcgacaaggttcgcctaagctttggtcggaccttgcggattgactggcccacaacacggccgggcccggggatctgatgctgccgtcactggtgccagagctcatttcgtacttcctaacacacactaatgcttcgttagttacccgcaaggctggagaacaggaatgaggggaattgaagtgaccgtctcccatttctttttctgttctttgtttattttgtcatctataaccaatccccgtttatatcgggtggatttagtagtagcgtttcctctgcatgactacacaaccctctcttcctaacaaccacgccagacaccgaaacatcgtcacttccccttcgcctaagctacttatcctgtcccttctgcccccaaccccattccccaaccccctttaatcatatcccatccaatatgcccacctctaaaaccaaaaccatcctcattaccggctgttccgcccacggcatcggcgcagccttagccctcaccctcgcccgccagggccatttcatcttcgccacagcccgcaataccaccaaaatctctgagtccctgagtgccctggagaacgtgcaggtcctccccctggatgtgacagactccgccaccatcgctgacgctgtgcgcgcagtgagagaacatggtcgggggctggatatcctggtcaacaatgccgggacggggtatacgatgcctctactagaggcggacttggaccgcgccaaagcagtgtatgaagctaatgtgtggggcttgcttcggctagttcaggcatgcagtgacctgctggttgcagccgaggggaggattgttaatatgagtagtgtgggggcagtggtcaatacacctcggattggttcgttctttttcccctttcgaagagatcagcataagcgaatcaactatacgtacaaacagggatctattcctcctccaaagccgcaatcacccagctgtccgagacgcttcgtctcgaactctcgcccctgggcgttagcgtgctctgtatcatggcgggtactattaccaccgacttccatgcaaatgagccggaagtcgtcttgctgccgacttcccggtatgcagctattggacaaaccatttcggattgggcgactggacaggctggtccccaaggctgttcggcggatgagttcgctaacttgattgccggcgatgttctgggaagcagtagtgctaatggggggttggtgtggaaaggcccgcatagtgccgctgttaagtttatggcgaggtggtgtccgggggggttgttggtgagttcctgtttaattgattctttgtctcctcttccgggtcgtcccgggtccccaaccgtgttggtcgtttgattggttgctaactagggccctaactaggatcgcttgatgagtaatgggcaggggttggatgagttggtgaagaccacaaacaagaactgaatgatagtattgtaacacagaagagagagtgtgtgggggagattgtgtaaagtaatcaatagtggaaagcaagaaccatgagatagccaagattgaattctactacctaaaccatcggtcaaatacatacgaatgcacgtcactgcggaatcttaaaccctcccggcaccaatctctgaaacactcccgtgggatcgacttcacggctgatctgccgcaaacgcgcgacattctccggcccataactggcgatcggatcctgccactgtgccgcgtagttcaaatagacaaatggatgatatgcattcaactcatgtgcatccgcctcaatacctgcaaacagtgatttagcagtttcctccacgcgtgtgtcatcagccgcattatcccaggtggcgctcagtagagtaaccacgagtgctttctcggagtcagacggcagtcccatcacattgtgccccttaggcgcccgcgcgtagattgcagcgggtagtggctccagggatattgaccacacgatgcccggcacatcttgcacggctgtcagactggtattccaccggacataggtcgctttcaacatgggcacggtcgcgtcgtgggtcgtcactacgcttagctgtctgtttgcgttgtcatggattagccctggaggatttgtaggagaacagcatgacatagatcggagaagggagtggagagggtgtagagacagtaatagacaaatccttaccgtttcccgttttgtgaaaaggacccttgctccagggatatctcgtataccggggctacacgcactgtgctgaataactgcgggatatcaaagaaggcattgtacacagctggtggggatggtggctgctggctatcttctccattcttcttggccttctccagcttcccggtatacacaatgctgttcaccacagcggcccccttgcctcccgcaaatccaaaactggtgatcaacgaggcattctcatcatagtggctcactgctttgggatcagccagctccgcaaacgcgcgtagttgggcatcgatggtgtctgtgctgcaatagatagacccgccatagataggaccctgcgggaagacccgcagataaaagcctgttataatcccaaagttactgttcccacccccgcgcagcgctgccagccactctggatgatgtgtttcctcatcccaatgcgcaatcgtcccattggccagaactatctccacgccgaccatgctatcgcacgtccacccgtaacggggtgagaaatacgacatgccgcccccgagcgtcagtccgccaaccccgacctgggcggcgcggccgcccgctaccgagagacacagcgggtcgaggtgggcatagacatctccccacgtagcacctgctccgacgaagacggtctgtttattaccattgtccgtggacggagccaggaccttgatggtgttgagagcgcgcaggtcaatggtgatgccgtgctggatgttcgacgctcccccgaaggagttgtgcccgccggaccggatggcaaattggcatctggcttgctcgtgcccgggcagagctgacacggttgtcaccaggctggtaattatattggaaacatcttcagctgagtccggggacaccacgcaggacggctgcagatcgctgttctgctgggcaaaatacgacttttgggacgcttcatatgcagtcgttttcgggaacgagattttgtctgaccctaaaattgaggccaaagtaaggcactgcacacatggtagagttagtttttgggtctgcatgggtttccagggttaaacgcacgcaggcttctagcggtgagttgttagccatgggaggattatggctgctattgaggggcgttttttccatggtgaggcgaagatacgagaaggaataagcttggaaacgaataggggaagattgagaagaaagaaaaatgggaaggaaagggggacaatgaatgcgacagggcgcagcgggttttaacgggtaggctcagtgtttagttcctgctaaattagtgctgcgcttagtgctgtacaggggtggtaaacctggagacttagcgttatctaccgtcatttaaactctaggcaaagattggtatttgcttaaagatgactgcagatcgttttcctttcacatatctcctatatcctattcaatcccagcctctgtctctagtaccagaaacatgatactctcagcccgctgcctgcactgttgaggactagaagtagtatatcaactcctaaaagccctctacctaatatccggccgcttattactccccttcagccccttcatgatagactcaacttcctcgtccgccacatcaagtatatgttgaggtggatacattggctcccacccaatcttccttccatgctcagccgtaaacatacacctagtctcacaattagcagtgcctccaagcgccccccaccccaaaggccattacttacctccccccaagaagcacctgaacctcatctggcgcaacaccaagcgcctcgcccatcttcgccagcacttcctcatcagcctgcacaacgtttccatcctcaaccaatccacgcttcgcaagcgccttagccatagcaccgtaaactttattccaagtaacactgcccgaagaagcaaggaagaagccattcttgccgtggccaatttcttccgctgatagtatcttccggagaatgtgcagatataagtttgctgtatcagcaatgtggcatacaggccatatctggatattcactgttagaatatatacattcgattggtgactagtatggaggatacatacgggatcatccatatcaaccttatgaacccggcgcatctttatcgcagcacgaacaatatcaacatcttggatcgaagtctggttgccgaacccttcccccgggccgtatacaagacacggggcgaagatgtagctccgcacgccgtgggcttcggctgtgtcgatgattgtcgcgttggtgttggcggactatatattcttagtgagcacgattggcaaaagcagcattcgagttaacttacttcagctgcaaacttatgcctcgacttcgccgccttctgaatatcgtacagtctcggatccgtatctaacagtgcctggtcgacagagactcccgcatgtcgactgaactgcttagagccagtcgtatgtaggaagtgcacttctttgcctgttctcttcttgacctctcctaagcctttgatgaatgcgggctggtgctttgcggagtaagcatcgatgaggtagtagacaatggtgatttctctgtcgatgatagtctgagtgatagtctcgtgatcgctaacatttagtatgagaggttccgcgccgtatagcttctctacctggttaccttgctcttctgatctgaccaaggcgtatagtttgccatatgatgggaggttggcgttcttccagcgtgctaggagggtgcctcctaggtagccggaggctccggtgatcaggatgttgtgggacattgggttctgtgatgtgcaattgaggtctctgggagttcaatctttctaattgtgctcttgccttgtcctttttctgggaaggaagagaatggttccagcaagtagtttatgtatgtctggatagtattggattaccatgtcgtcgctgacgcgctaaccgcttatggatttctcctgcgattcctattggtcgaagctagtctctccccttccactcacaagtcttccggttggtttacgccctcattgacaatttgaaatcaaaaatgcattttgatcgtcttcacagaccttcgaacgctgtgattagcaatcatcccatactggcggggttgatgactgtcgtggacatattatccagtctccatgccccatgacagccaataggaatcacgggaacgctcaggtcgcaacgaccctcgtacatttcctctcaccacgttattgccagaagtataagggcctggcagagagttctcatcgcatatgaaggcgcaagtacatgattcgactcatcagagattacatcaattgtgtttacccccttgcagattcccacatccataccatgcaacattacatctcccacttcgacggcattgacggcctcaagaaggaagatgtaacaattccatcacccggaccaggagaggtcctcgtccagatccgtgctatatcactaaactaccgcgatatggagggtaggcaccatcccctccccaaagcatcccatgcactcaataactcattcccctgaacccagtgatcaacggcgaatacaaccatcaccgcgcgatcaagcaaggttcaagcataatcccctgttctgatatgtgtggtgtggtgcaaagtgtcggccaaaatgtcgccaaatggaacgtcggagatcgcgttgtttccttattcgttccggatcataagacgggaaaactgactgagagagcactcgctaccagtttgggccttccccagcaaggtgtgctggcaacgcatcgcgtgttcgcggaggatgcgctggtcaaggcacccgagcacatgagtgacgaggaagcatgcacacttccgatcgcgggtgttacggcatggatggcgattaatgggactcggccgttaagccagaatgggggccggggggagtatatccttcttcagggaacgggaggtgttagtattgctgggttgcagattgcgaaagcgtctggggcgaagggtatgttcacctgcgcatttatatatgactctagagttgaccctgtgggatagtcataattacttcgtcgtccgatgagaaactagccaaggcaaagggtctcggagcagactttggtatcaactatcgtaacacacctgaatgggctaataaggttatggaagtcacgaacggacatggcgcggatattattctcgaaacgggtggttcgcaaacactgggccagagctttgtgtgtgctgcgtacggtggcctgattaactgcattggatatacctctggcaagactcaggcttctggagagcagaagaacgttaatctgctcactctgagtcgcagcttgaccttaaaggaatctgttaacggaccgacggatcgcttcgaggagttgattaaatttggggagagacatgagattcatcctgtcatctgcaaggtcttccctttcagccaggcgagggatgctttcaggtatctggaaagtggctcgcactttggaaagattgttatccaggtttagtgggtgcacatgtcgtttgggtatccggcagcaaacaacggtcatttatccaatgtacccattgattgattcagagggcatcctgtttaatttacgaactgtagcatgaggaaggtctgtacgtagcataattttagtttcactataagtgctcggatgtagggtctgcagaatctccgaacataggtacatgagaaaagtccatgaaggcttcgttgactccatcgcaatagctgggccagatatcgggatcaacgagatccgcccagggccaaaataaatcattacttgtttggttctctggaagtgacaagatggactgatcgatgttcgtatttcgaacatccatgtccatgcttatcgcatgagatggttgatccacccgttgcgtcagaccatcattcgtcgacggaggtacaccttttgtgctttcggacacaccacgccggagatcaatatccagcatcatagtcaacttatcgaccttctcacataggtggcgtgtgagacatgctgcacgaacagcggcgtcattttgggaacccgcaaactcgaacgtctccaaggctaggtcgacgtagccgcgtgcctctggacagcgtggacagaatgggaatgccaatataaagcccatgagcgtcagaacggcattccactgatattgataaagttcgcaagatccatagaatatgtcgtgcatggtcatacaagagtagactgtgtggatcgttgccaaggcgtgtttcagagcagttgcagcatgtgcaccggcaaggggattttctcggttcatcgccggctgacgaggaaactggataaaaactctatgcagactgatcattgcgtcgtggtattggagctcgagcaaagcctccgtttggatctggagtggcacttttttcatatagtcattgtactcatcgccaccatcatctcctagaccacagaaatactttcgtgacactggttcatcttgaacgtccagttgaagatgcttgaaccatgcgttttgccgtaattcatctttccacacacgtaaatgacgcaaattctttgtcagaacgtttgcctgaaattcaatgtcatggctttctcctgccttttcgtgatgtgtgttttcgtgatgtgccattgactcaataacagccagtgctgcacacgtgagacgaattgattcattatgatatgggaaatgtaccggacggggtggatcattcgacatccaacatggtggcgaagatctatatataggaagctgcacactgacaggcttcccaaggtgccttgagcagcgaaagtcgagatggactaaggtccaccatatacgagagtagagctccgcctgctctcgagagacttgagggggcggattacagtcaaggtccaatgatcgagcaatacgaacagcgagcccgatcatgttataagccgcctgatgttgtccagcatctagtaagtacaaggtcatgatacagtagcactgaaggattggaagtgagggcttcgcaaacgttgaatattgcatcgcgccagttagacaacgttggaaataaggcatgccaatcttctttgagcaccgattgcttcttttgaactgcttccattgcaatccaagtaatcgagaatggaggcctgagtagaatatgtactgcatagtgtaggctgttacagcatcccgcagaggttgggagccggtcagcgtatcttggtcggaaagagggtgctctagatcctctcggcgaacaattggaacttgtgggagtagccgtgcccaaaaaatctctaaaacacgatcgacctgatcagaggataaatcacactcaaccacagctgtgccatctgtgtcatggggggtaaaaggagatgagtaaggagggttccccgccgaggaccgctgagtcgtcagttgcgatacaccagcgcagaaggtgtttatgcgatcaataaagccaagtgttgaatccaagcgatagttgatcggcgctgtgtctgtgtcgtcggggcatgatattatgcctgcgctggatttctcccttcccttgacggcactggttttcggggtcacaggaagtgaggatggggacgcattcatagcagcaccagaccgatcagatggactggcggagcgcctgagacgactacagggtattttgttgaccacgcattgatggcagggagcgactgcgtcacaacgcactcggtgctctcgacagaaacggcatgcccggcgcactttgcggcgcctaggtactgaacctgtagttggaaaggtatgtagcatcgttttattcaatgcggctcaaataatttgttggatgacgttttctgagcattgctgatttagcgtcaaaagtggtcactggatgttctttgcaggctagattgaagattagtcaccaagaaatctcacgtgtcatttgtcaggttatcgccgcagggacgctgagctggcctacaagcgaattcacgatttatatcacttctcaaggttcttgtgatctgtcaagacttaggggctgagtattgctgcctttcagctgcatacgttgtggccttactcagccacgcttcaaagcgcagccaaaagcttcgttggtgaactggctggaatgccaagaatgtgcgatgtcttcgacttgttgacacacccatcccctcaaccccaaccaacctcacatagcaaacacagccatgctggagtgtaatgttggagattgcaccaggctggctgtacacttagacggtaactctgttatttgcgagcgtcatctctgtgccaaacatatcgaacatgaatgtcctaagtggcaggtgggcaggaatatacatcctgctctcaagcctgactttcctattagtcgatgccaatgacggaagtatatacgactcggccgctcaagagacagagggaagagagatatagagactctaaagttgtctgcacttttcgagggaagaagctatttatgaaacgcattgcctgctcttccccccagcctcttgtgtatgagaggacgatgcgttcatcagttatgggcgggatgaactgtcacatagaaattttgtttgctgatggagttcggtggttggctcgaattcgaagatctaacgcgacttcactatcacccgacctacgtgactatatgcgcagcgaggttgtgattctttgatttcttggcagaaccagggtttctgctccgaaggtattcgactatgcactacgtggcgaaacacaagttggtatcgggtatattcacatggaaaatctcccaggaaggtcattacgctggtctctggcctctccggagcatacgaagaaggttatgacccagctagcggatgtataaattgagatggaatgttttgcatccaaccgtatggtatccatggatgaaccaggagctgatcagcttcctttgcccgggaatccttgaccgaataatatgtcaactcacagatgatttccctcgggccatacgatgatccgagagactatagaggctagcattgagctcattctggggttgttatgaaaggggaaagctatgcagaatacgacataaatgcatttctagtccatcaatttcttcctgaatgcatcccaatattaattgaacaccacagatttgaagacggacgattctatctacggcatgccaatgataaaggagatcatatccttgtcgatgacgaatgaaatatcactggaattgtcgatttagaatgggctgatactggcccgaaaaatgaagcctttaaatcgccagtggtgcttctcccagttgctgacatttacgatagagtcaatatcgttggggaggaagaatccacctttgcagatatactcatgaaaaaaggacttgcagaaatagtaagaaacgtgagactgcttcatcggttccaattttgtggcgagtatgactttgcagattgggaaggttccttgggcctttttcgaggtcggaatgccttggatctagatgcagatataggctggcaagattggaaagcgactgctctggaaagaaattctggtaatgagcgtcgtctctgctgaagcaggcaagatagagttttcatcctccgttatcaggcgattgctttttgaagggcatgaaaaagttgcagagagcgtgtttatacctagataccgagtgtacttttatcgtaattgcaaattcaaagataaattcatggtagcacatcactaaagctacatataagagcccgttgtggtcagctatagccaagaacctcgctcacatggtatatcgaaaataaatattcttcatatccgtaacatcctgctctcccagctccttaccccgtcgttcctgctcctctttggagatccccatgctcagtacaatgcgctccctgcgtcgattctcccacatataccatcctctccatagaagaatcacaattgcctcgagagcgaaacataccgagcaggccaccgttcctgacacataccggggcgcatctttggtcctgaacacttgcgcacctgccatattcccggcgcaatacgcgatcaaagtcatagcggagacaacggtttgcttggtctttcctgcgacattggagggggtataacatacgggtagggaaaatggagtacgtactcaagctccaacctagaaaaatagcgagagaaaagacaactgtcatgatgtacatcccccacttaatccacttgtactcgggtgtgtttgggaggagcgacatcaccaggaggccgataaagggaatgatgcagctggcgatcattacccacatgcgctggttctggaacttgcgggtgtacaggccaacgatgaggaagacgactacgtagatagctggagcgacagagagatttagcactaatttctcaattcaaagatacaaatcgtaccgttccggggacagccgtagagcatggattgccagtcgttaaagccaaatgtctcgtacatgagggagctgaaagtcgtgatgccgctgtgtttaattgcggattaattactgatcaggtcaaagaggaactgtgtgtagactgacccgttggggatatttgcaaggaaagaattggcaaatgaaaagtataattgagggtctttaaaggcttcatagacttgtggccaggaccactgtttacctgtagtatcctggcctgtctggttcttcagtgtgcgggcggttctatgatagtgagtagtctgctttcgataaatatgggatgataacttacgccatgcgtttctcatcatcattcaaccaccgcacttcatgcgggcaaccgagcaggaagaaggcggctactgcgccggccagggtaagagagcccagaaataaggagatgcatcgccaagctgctataccgccatgggcttcaacatgtcgcgcgatggcgtataagatcaggttgcagacaatggagaagaagccctcggatgactgccagaagagggagcggttggcgtgttcttcggtccggtaccagagaccagtaatgaggaggaagccgggggatatattgctctcaaagaacccttgaagggcgcggagtgccatcaattgagaccagttttgtacggcgctgatacagatgaggcatatccctgaaaaggttatttatagttccgcgtagggtagtcgtagaaagcatagcttaccccagcatgtcatatagatggagaggacaaggccaccattgaacctctgcagaagatatacagagggaaattccccgatgagatatgtgagatagaaactgtagggacagtcaatgcaattcatgttccgggtggtttacacttacattgtggtcagccattgatactgttggccatgtaatttcaactcatcctccattccaaataactgggattgtcagcatacgcatttatctcctagtctatgatacttactgcctgaatactcgttgaagtcttgtctgtttgctgtatcccatagaagaagaacctggaaagttagaataggctttcctagaggcggtaggcacatacatcatgggcatgaggtaatagtcgatcttccgtgtcagtttcttgtactgttgctctgtgtaatctgcttcacgtcaacggtgttcacatatgcagcaatgatgattgcttacctgacgctagaatctccccaacttcaacgttggtggtcgcttccagagcagcatcattcttgtccgttgactttcggtccatttctggtacgtcctcattcaaagtaggcatgcctgtctgttctgtgaatatcatccaagtgaacagaaaatttcagattcgacgtgatatctagatgcggtgttcatatggcacaatcccccaagtgttgataacagataacagcaactggtatccgataaggaagtcagtctacaccaatgcctttcttaatcttttcatagcaaccattcaatacgccggttcggaaacatacagcaacggcatgctagtcaacggtcaaggccgagaatggcccattcctaatgcatactaaagactgcctatccataaagcccctccattccatcgacggtgatactgacgttcgacttccatagataatcggcgaagcccgagcaacaaagcttccccaccgcgataagccgaaagtggagtagagatcggccatctgtccgcccccatccaaccctactgccgtatatacaacaagcccccaaagcataatccttcaaccccgcgcgagacaacgcgcgttttctcttcccattcatccatccattggcaaacaaccatgtccgctcccgtccccaaagccaccacccccttctggcgcacccagccccatcccctcgaccgccaccgcagtaccccagaccttcctactgaatgcgacattctcatcattggcgccggcttcgcaggagcagccctagcacacttcctctacaaggacaacccctcaccaccatcggtagtgatcctcgaggcacgcgaagcatgttccggagctacgggtcgcaatggtgaatgaatatcatcgcctcttcccccaatctcatcactaaccaacatccaaactagggggacacctcaagccagacgtctacctcaatcttcccaaacacatcaagaagtacggcgtagaagccgcagtggaagtagccaagtttgaagcctcccaagtccacgccgtgaaggagctagtcgagaccgagaacattgactgcgacttcgttttaacccgcgcatgcgatgcaacactggacgagaaactagcgcgagagattgaggatgcgtacacggaattagtcaaatcaggcgttgctgatctcaaagatgtgcattttacaccgcgcaaggatgccgagcgggtgcgtttatccctccctccttccctcacctcttgtctttatcacatcactaaatggttatataaccaggtatccggcatcaaaggcgccctgaactgcttcaccttcacagcaggccacatctggccctacaagatggtaatgcatctcctccaaggagtcgtgaaccgcggtgcgaacctccaaaccatgacccccgttacatctatcgatgagagccctctacccgatggtcgctgggcagtccacaccgaaagggggaacataaaagcgaagaaactccttctcgcgacaaacgcatacacatcccacctggcaccacaattcaagaaccacatcgtcccggtgcgcggaatctgcagccgtatcgtcgtaccagagggcaaggtagcgccattcttaccccaaacgtatagcatccgatatgggccgtcaatgtacgattatttgatcccgagaccagacgggagtattgttgtgggtggggccaagacgaggttctgggcggagaagaagcattggtacgacgttgtggacgatgggaagctgattgagcctgccaagacatacttcgatgggttgatgcagagacattttgttgggtgggagggaagtgaggcgtatacggatcgggtgtggacggggagtatgtttcctctattcctgacatggtctggggagtgcatttgctgactgtttccagttatggggtatagttccgacttcatgccgtatgtgggtgaggtgcctgggaagccgaatcaaactgttctggcgggtttctcgggacacggcatgccgctgattctgctttgtgcaaaagcggttgcgaggatggtgagggagggtgctgcctttgaggatacggatgtaccgtcggtgttccgggtgacgaaggagaggttggagagtacgaagaatgagattctggaggggttggaaaaggagcatccctcgagtaagctgtgagtagggtgtggaattgattaagatgtgatctagtgtatagcgaccaggttattgcttgggggagtggataagcaaagaagcaattggcacattattcgcatcttcatatcataccagaaaattttaagcctcctagttagtctccatcgcagcagtagctgcaataatcccctccgccagcaaaggcaaactatccgcctccacatccatctccccaaagatatctgaacatgtctccttctcccacacagacacccaagcccctttgaatctatacaattgacattagtaaattttccagtcatcccaaacatatataccaactcacccgcaccgcttcgccgcagccgcatcccacatatgcgccgccgcaaaccaagccaacgacccttctccttcaaacttctccaacaaatatcgatacgactccggtgccggcttacccaccccaattgtatcacaggagacaaagttctcctctggaaatttcactccaccttcagcaagatatccagccactcgggacgtatcccccgacgtcagagcccaaactgtgaacccctcatctctaagctttccgaaacattctgttagccccggacggactttcaaaccgcggtacgatgcaaggagatattcgcggtcttcatcggtggcgaattctcgtggattcaaaatcccagcttgccagagcgtccggtagaagatggagcggaaaacatcgaagaatttgacgtagtgggttgagagactcaggtaggtgtattctttttcgccggcttccatccacgcgtagccgaacaggcgggggttgatgttgtaggtgcgcagcttggggccgagacgcgagtcgatggcggaaaagaaggcgtcgtaggagacgcaggttcctaggatggtggtgacggttaacgacaattgactggggacttaatggtatcttggcttacctacgacgtcgaagacgacgtgcttgtttgtggttgtcatgttggttgcagtctgtaaaatctgtctcattgacatgttatgatatgtatccgaatgacttcgttaaatgatctcagttgggtccctcatgggcaaaggagctccaaccgatgaagagtcatcggtgaaccgcagctaaaatgaggaagtagacgggctaagccgagaccatcgccgggtctggatacgacccctctgggggctatcttatcaccgagaagccctatctctcgagcggggtcacccagatttcggaagatagccgataaacaagcaccgctgcagggatgcttgagggaccacgtcagctcggcattcagcgactgcctccatcctggttgcgcagtgctgcgatattgcatacccctcatgtcgattacccctcatttagtaacttggactcatgtgcttcctacaattgatcgattttggatggtagatcggaacccatggagcagtgaacttcactatgtcgcaattcaccattcatacgtcgtccttgttcgatcccaagctcaagatattccgtcccaatgtctctgtcacggtcgatcctgtcagtggcctcattgtgcgtgtctttgaacgcgatgcggagacaccattatccgagatcctacagcctggcgatatagatctcagtggaaagtatgtgttgcctggactggttgacgcgcatacgcacatcttcctccattcgtacgagtaagttcacccaaaagtatctgaataagttccataatcgcaactgagcaaatcagcgaggcaggagcactccagcaaaagcgcgatgagagcataggagaacgcatggtccgagcagttaaccactgccgcatagcattgctagctgggtacacgacctataggtatgaatgtagccttcctcccacctgagtggagagggtacagtagctcatcccatacagagacctcggctccgaaggaatgcaagatttcgacgccaacatccgcgacaccatcgctcgaggcctcactcccggcccccgcctgtttgtagccaccaaagtcctcgccagcaccggatccttcgaatgtcggacagaaaacagcgcagggggtcactgcctcccctccagtgccgacgcagtcgacggtgtagaagcatgtcgccaggccgttcgtcgccgcatagctgctggtgcagacatcatcaagttcttcgccgattaccgaaggagaatcatgcgatatccccctgcgcaacaacagccgtatattgcgggtgtcctacatcctcctaaagaaccgaatccggattacatggtattttcgaaggaagagatgcagacgatcgtggcagaggcgaaattggctagatgtccggtttcagcgcactgtgcgacgcttgagggtgcgatggctgccattgaggcaggagtgtccaccattgagcatgcgtatcatactacagatgaaatgtttgagcagatggtgaagaagggtgtgattctggtgccgacgctggctatagcggagagattgcacgcaagacggtttgatcagatcttgagtggggtcaagagggcgcatgagatgggagtaaggctggcttgtggtggggatactggcacctatcctcatggtgagaatgttcgagagctggagctcatgatccaagcgggtatcccactgagtgaggttctagaggcttgtactgtcggtggctgggaggcttgcggaggagatctgtgtggtagacggtttggatggttcgaggagggaactcaagcggatatcattgctttgtgtggcaatccagaggaagatccgggggctttgaggaaggttgactttgtcatgaaagatggaagagtgtggaagattgacggcttacccaagggcatgttctagtattgtctgggtctatgttatcgggagtagagatattctgagtaataatcagcccagggtcctcgatgtagctgtgattcaaaagatgccgaattattgatgacctaattcccaacccaatactccataactcgcattggaggcaacgtttccgccacttgatcaggtttaagacctctataattgagtggctgagcccctgaagaaagatggtcattcgaatgcctggttgctcttgctaattgttctcgtagtttctagatacaacgtgcttcttgttatgctcatgggatgcccataaccgtcccagcggtctccgctatagtagctgcacacagctcttgcgatcgctcaaacatccgctgcaatgcattctcgtcccttggtatgaaccgcaccttgaaatccgacgcgatggcgttcgatgccgtcggatcgcgcttatagtgcacatagtgggtattcggcggacattcttcctcttccactattctgaatgagacaatgagacgaaggatggtcgcatataggactctgtttgaaaattttaccgcggtacacatgcgggagcctgcaccgaaggcaaagtgataaggcggaggaatatcatgctctgcctttagccagcgatctggccgaaattcatccgcatccgggccatatactgtctggtctgggattgataggttagtcgaatatcccaaaagcaaaacaaggtggacacccataccacgattcgcagcttgcgcgttcaagtagatgagaacaccttctggaatcacagcttcctggtacatgaattctttaaaggattgccgcgccggaagaagtttgagtggcgggtaaaacctcagcgtctccttgacaatagaagagacataagcacacttctcttcagatacacaaagttcgaatgcatcttctgaggacttgtagacattcaagatatctgcgtaggccctctcttgtatatactgcccctgtggggttgataagacaccgattgcaataatagcggtcgagaacacggtctcgaagcctcccgacatgaggccgccgagtattgtcttgacatcgactaccataattagccgaaacttatatattcagacagaaaggtacttacgttttgtcaggccttcttgctcatctgtcaacaacagtttggccacacatttcctatctccagttcgcaggcggatactttcgcgagcgccatccaacattgtggccaaccatttatcccgacgttcacggacctccagagctgtggcagttcttccttccttcctccaatatcttaagtaaggaatgaagtcttgtgggttcgagttggtagaacggaaactagtcaagttagaaggacagtgctgggctcgcaaagctcgaatacttcaccttgcaatagtgctagcgtcttcaagaatctggagcagcagaggatcggtaatagattcgaatcgtgtcccgtagcagaacatcatcataatattcagcgcaaggcgcttctggtagatatgcggaacaataccaatgcgcccgttctcactgtcattatagattcctgataccatcgaaaacgtctctagatctaacatgggtcgtaacttctggatagccgggccggtagtcagggagccgacaactcgtcgctgctttttcgtccgctcattccaagggcttgttccgatcgtggcagctatgcatatcattaggattgaaaggatgcattaacccattttacatacccgaggttgcagagactaccttatggaaggtgtagaacgatgggcggtccaaagtcgcggactggtttttgatcatccagtcccgggcggcattgaacgaatttatcaccaccgctcgtcggtgtcccattcggatctgaaagacgggccagccaaacttcagtgaccagcgttctgcggtggtagcatggtcgtttcccagctggtacagatggcctgccaggatctcgcctccagggatttctggaataccttgaatactggggaaatcaacatagaggtagcgtagatatgatagaatcgcaattgtaagcactcctgcagccacgacgcttacaatgacgaggttaaaaggccaataatagtcaagtagagcaaccatagtgaacggaattgctggtatgccaaatgattgacaatggtgatggctttgagatgttagacaatgtcatggtctatctggccattgtagatgtgagaagcaactctttgactccgatatgcgcgtcggaggaaggcgtcgaaatgggcggaaagctcggagaatagcgagcggttttcaactcatcttccgtaatttccatccccctctgaaataaggacaaccatatttgccatacatcgactggagttctaacattcatattgagtctttaatattgtcatggcaagcaacttgcgtctggaagcgctcttcgaggttaaagaccgttgggtcgccattaccggtgcaggtgaagtaccatccaaggaaaacaactggcttaatattgacatcttgctatcaggtagcggtataggtcgtatgttagcacgaggttgtacagtgaatggggccaacaccattctcatcgatgtcaatgagcgttctctggaggagaccaagacagagcttcaagaactcagccaatctggggacttatctccgacctctgtagttacgtctgttccccacgcatatccggtcattacattattctgagtcaattctagaatacatggcgacctttccagcgaagcaggtgtcacagcggtcgtcgccgcaattaaatcaatacgcggttcacttgatgctctcatacattgcgccgcagtacgctatatgaacgaggttacttataagcctggtggcagtctgggtgaccttgaagatgcgactatgtctgccccctatcaaggctgggaacaaacctttcgcttgaacgtgctcgcaccatattatctgactgcgggtttagtacgcctgctgggcacagcagccgcgaaaggcgatggtcgaggctgcgtgctaatgttaagcagcccagctagtgtgcataatcatcaatttgtgccctgctatcagacgtctaaagcagcggttgatcaccttgtacggatcatggccgctgagttcgcagactactacagtatgttgtagctcgtagctccacccatcattttttctgcgacactcatctagtttcatttacagttcgcgtcaacgggatttcaccaggcattgtgccttccggaatgaccacgacagatgccaattcaaatctccacctagcggcagaagctccagcgggccgagcagggaacgaggatgacatggtagggaccatgctgtggttgatcagcaaggcgggcgcttttatggacggcaaggttgtcagggttgaaggcggccggcttcttattcttcgaggagcaacgtgtcattccggttgatcagagaaattgctagtacccgcatttcaactcctttttgcggaaattttcagcatagatgagatttttctctcctatagttttaagcctcaatgacttgcatgacaccgtgcttgccaaattgactatcctgattcaacttctatgttccatatggctatgcaaaaggtccataatagtttgccaggcatgaaggtaagattggccacccttccaatgagaagagaagaaggttaggatttcgctgcatagaatcaagtctctgaagtgcgactgaaaggatgtccacctcttcactatagctgtcgctagtgagcatccagatataagggcccttgagcacgctataatcggtgatacaaactcttcctcaatgaaggttgctctgtgtgtatttgataagagttctgccgctgccctgacaatcttacgtcttaatgttctcatcccctttccctgctggtcgtccggttcttgatagcaggccacgcactgcttatgcctgacacaagttgctaggaggacaagccagatttcctgggatgctgggctagcatctgcaataacatcggccctatcaagcagccctgagacttcaccaacaaaagggcagctttcggcatcaccaattcgactagtaccgtaggttgcgtggaatagtttgttgtataagatagaagatatatccttttccggtgcgcaatatgacatatcttcgatcaacaagattggccgattggataccgttcgtagtgacctacaaaagatgagccaagaaggactaatgaattcagtgctgtgcccacccttcaatctccctaagtacgcacatgagatgggttctcacaggatcagctgaaaccgattcctcattactagtgaagtcgttggagttcgacgcggttcggttccagcctagctgcaagcatgttcttcgcgcaacatcgaggagttcccagatgatgccgcgagttggatcggccagttcatatacgagaagtagtaggataactttcatagaatctgcgtccgcagcacaaatgattggggcgatgaagtcattagcccactcacgacacgtatgggcgaacggcttccaatttggagatttgtacgttttttgggcggcggaaatagaacaggccatcagtatttgaaaccttcgcatttccgggagcttccgtaggtggatgccgtcatggctcagaatatcaagctccacgatatcatattttggtcgaacgaagcgatggtagtctttcagaagcccgcgcaccacgccaggtgtaagcatggacctgtcaaggtgcgggatatctggtaacgggtcactttctttatcaatagtcctccagtcatttgttttgtgatgttgtgaaagtacctcgagtgtgacctcgacaagacgtgatgagagtgaaagatctaggtacatatctctaccagatttaggcataaggatgaaggaagagaccaaggaaggccgtgttgacatgccatcaggagacctctctgtaaggccacttccgccctccatagtcagattagcttcgggcagataatactggcaacgacgtcctttcaccttgaagagatttgagagttcaacgctagctcagagttcagcttctcgattctatcctgcaatgtcttgagatagctgtgaattgatgagcctatggatgattgagtgtgggacgccgtcctgctgaccctcgggtaacatctgcttgcaaagcttcatctcgaaaggtacattcaacatcatgcttagagcagttggcgcacgctggaagcaaggagtcgcactgcaggaacgtgccttagtctactatttgatgataattgcgataagggaaggtaggtaccttgatcctccggcttctgcaacgggtacacgtcggcagcatctctgacttatcacacagtcgaagtgaacagcctgttttgctttattgtggtctagtgtgtttcagagcacaaacaactcgatccaactgctattttgtttgggagagagtcgaagtgggcatgagacgaccgatccaattctggtctagcatcatcacggggtgctgtgacagtacgctaagcctggaggggtaaggtagatgtggcttgttttgatgcaattggttgattctcttccttatcaggtgatgcggggaaatctgtctctattactaagtagatattaatacacagcagtgatctgtttatctcgcagtctctcttgactttatattgtctcatgcatgttggccgccaacaatgccacgatcgagacgctcaactaaagtatgttcccgctgccggaagcgcaaaacgaaggttcgatcccacaataccttcttccaattatttcttctgttgctgtaacgtccgtgctacatccatactccctctctaacgcggccatgcaccaatagtgtgacttcatcttcccagcatgtactccatgcaaactggcaaatttgccttgcttgggctttgatcctagctccaaggaggcagtccccagaaggtatatatcacatctcgtctatagtcactggggactgacattgtgttccaagcttcgtcaagtcactcgaagctcaggtggaagagctcgaagcacgactgctttcgttcaacgccgcttccaccaacgttccgtatctcatcactacggccgtggcacaggccaccatatccattggcattccctttcagaactcgtttctcgactccaaagcctcatcttcattgttcttccggccctcctgtcccccattggcaatagcccgggaacggggacaatccactcctgagagacatcccagcttacagaataatcgacacaatcccggcgcgcccattaatttacgtagtgttccattttctgcaatcaatcgtatgattcggaattatgtcgacatccacttgcctcagtacccctgcgtgtcagaaaacgcggtaaatgaaatactggacaggatccagcatcaggacctgaaggacccaaatgctctcccgatccaccatgtacccactgatgctggcctggggcatttcgaatattttgtattgcttatcgcacttgcaatctctgcgatgacattgacctggaaggccgattaccaagctcgagtggcttcggagtctttctataacgccgccgtaaaacacctacaggccatgacagaccatagcgagattcaggcactacaaatttctttgctcctagctcactatgcgcatatgtgcccagagagggtagacaattggacttgcatttctaacgcggtccggattgtcctcaatcttggactctatctggagtgcaatcaactggttcatggtgagccttatcagcgaagcgtactattttgggtagcgtacggtatggagaggtcattatgtacgaacctccgcctacccttatcatttccggaagaggcaatcacggtaaaggtaggtttcccagacgaccctctggctctttgagaaactcaagaaattccagtttcccacaggagaagagacaaatctccatacggaacactccaccggtaggccgtgcaagaagtatgtcgcttaccatatatgtcggtaccgtgcactagagacagaagttcatagagtgcttcatctggaagaagacttgaccaagttcggcaataacactatagaggaatggattgaaagcatcacccagagattggaacagtggtacgagacggcacagtcgtacacaaagtatgatatgcttgaattcaaacatgtgcagtttcaccacctcatggcacgcatccaccggccaacgccgcgtctaagattgagaggtccagacaactggaaagctgtgttaaacgcatcatccgttttgatacaggactacctcgctcaggagcgacgtcggaggctgttctatccttggcatggggtacatattctcttcgaaactgccgtcatctcgctggaggcatgctggtcagcacggaattatgaaccgctacaagttagggctcatgagatgttgcagatctcgattcctcgatgtcttcagcttctcaccaacatcggtgaacgttggggtgaagcagccgtatgtgctgatcggttaaggccgctcgttgatactgtcaggaccgcttttaacaatcccgatacgctgttgctgactatgattgatgagagtgtgatcacggcagagatacttgatttacttttcacggatgggccattgtcatggacccgagccaaccgtggggagataatgtctgacatgattgagagtgatccatggttaaatagcctggtggatgacagcctcgaacttttctcgtggaatcctgaatggtgcatcatgcctgctgacgcaatctccatcgagggatatacgctttaaccgaggtcatgatctgtactacaatggccattctcttgtatcgcttttctctttcgctgagaattatcattactataacaaactatctctgatccacgccaatacccatactcatgagcgtttaagaaagattggcaatatatagcataagactagtcagccatactggcgcaaaggccgcaacacccgcaaccgtattctcacgcagtcgtgtgggcaagcccgcgaccgagtctttctatctggctactataccatgtctgagaatggaagtaatgttagcgagtggcaccccaatcacatacatttcacttacactctcaaggccggctccaaccgatctgttgctcaacatcttgaggatccaaggctgatttatctgttgcgtgacaagccgggcgctctctgccgggacatctgggttcaagaggatgtcatttggtaacgtgggtttaagaactgccggacgtccaatccctatcatgtcgcaatccttatcaatcagtgctttctccataccggttcgagtacggaagccgcccgtcaccatcaatggagtccctggaaattgcgctcggatagcactggcgaactccagaaagaatgcctcccgagccaccgtccgagcggacttctcgggctgtttatttgatgcggaagaactcatcatctggtcatcatcagctgtgcaactaaccacatgccaaggggtcagatcatcttacctggggatcctcgtacgacccaccactgatctcaacaaagtccactcccgcctcaacgatcagcttgagctgttcaacacaggccttcaatgcgctttcggattgatggtcgaccgaatttaattttatgcccacgcagaacgtagctgggaccgctttgcgaatcgcatggatgatgtcgacaataatcttaacacgaccagccggcgaaccgccgtactgatcagtccgtaggttcgccgtgggcgaaagaaactgcgacaaaaggtatccatgtgctgcatgtaattccaccccctggaatcccgtttgtgaagccaaacgactcgtataaacgaactggtcaaccacatgatcgatatccttctgggtcatttccctcggggtaccaaaaatcaccgagctcgcgaacctatctatgatccttgaaccaaaactcaaaggaatggggctgggcgctacatttttggctgtgaggcaccttgagccagcacccatgggagattgccttccaggatgacagatttgcatgactgttggcgtgccgtgcctggtacaagcagcggaccactcgcttcatctgcggatcaactctggctcgatagccgggtttggtgcaacgtcacgcgcatctccaaggtacattctatcaacttggacatttcctatcccaaacgttcaacggcttattcacgaattgccaaggccttttgcacggcaacttacctgtcaaaagcataccccagccgccgcgtccccactcggcataagcgcgattatgaagctcagtgggcaagttatcgctatcagacatatgttctgccattgcagccttcaccagacgattcttcatttgcagcccacatttaagggtcaggtgttctgagattgcggactccatggtcgattttcgaatgtaggatacaccagaaatcaaactgcgatatgaaatagcaaactgggttcttcttgcctttctgcagttaatttatagacctcagggaagcatgtacctgcccgcccctgaacttgaaattggtcacataagaatgccaccttgctcaataatcgcctcccagggttttttttttttttttcttcccgcttctttctagaaccagcctgataaatcaatcatctgcctccgagacccggacgtcgcgcgacagtgcaatcatcttaaatatgagtaaacgaccaatgaaaagcgtaatatcccgtcggtttcgaggaaaagctgcgagttctggggcaatattggcaaatatgtcggaactcgatcgagatccgagagtgggtgggtccggttgagctccgactgccgagataaagtctccacttagattctgctcgggtttcgggtatcgttttcagacggtccttgtttgcacctctatataagagggaagcggggatggaggagcctcggcttcgtagatcttgtgattgctgctgatgaagtgtgctgttctgaaaatctgccagatggttgtactatgaagagcggaggaggggggagaagagccagatcgaagattctggtggcgatgttatatataatagggaccttgaggcatggacgttacacttgcacgcgcgtttcctggtacgagccccatctggagttaggtgggcactgctagtctgagacagccgagatttaagactcaaaagcttgagtactaccactataatgtgatgtgactgcggttgaagtcaagagatacgcggggagtaagtcattggggattgagaattaagtcttggtcaaaacgggctgccgttcgacgaactgctctatcccaatggttctctccacttcataatgggtacatcaaaaatcattcgatagtaagttctcggaattgttcgattcattctattggagtgtatggctcggtagtccgttcctaaacacttgatatcccagtacgtgaatataccacgaattgtggttacgtgtatatggaattgctaaacaacgagtctatcatgatttgctttagagtcaaacgggactatctgttaagcccggatgtaactcccaggatgacagtcaacacaaggtcatcatacaaccaacgaataaataaaacagaatacagtaaacatcacacctgcgctgccgtaaacccatgacaaggccagtccggtctcggaaagcgttggggtcgtgtaaactcctcgaagaacatgttcccggtgctaacattagcacgcacagtatgcgcctctcgacccggcacccgaccatactgaagcccacgcacactgggatacagcacattctgcagcattgccagcgctctatggttggattggtcaaaccacaagtgatctggatggacaactaggacggtgttatccagcgccgattgtgcgtcgatgaagaaaatagggaattggctgtcgcgttctccgcgataggtgaagacttcccagaagatcttccagacgtcgtcgagggtgccgtcggcttcaccctcccagggaacgtaacatgcgattttagttccccagtgattctcttccacttcgcctattgtgcgaatttctctttctatattgtctttatcggacgtgggaaagctattcgtgagataaaacactggtatagtgtattgtcctttctttgctgacagccatcgcggcgggttggtgtagaatggctggttgggcgaatacagtaactccggctcgacctttttactatacatatagtgttctgcggatattcctcgtctcctcatcatttcggtccacgggcctctgtcaatgattatgtttttcagggatattcgtgccacatttggcatatcgccccgttcgtacttgacaattcctagttcgaggtcgtgagcgttttgagtgacagggatttgttggagaaagtagatattaaatggggctgagttgtcccccgctctaagccgatacgcctcccacaggtttgcgatttcacggcgagacctggctctgtgatattcccacgggataaaggtaatggtatatgaccggacaccggagcgctcgatcttccggtagtcttcaatggcatcctggaagatggtttgaatttgatgaagctcgggtggtgtcgccggaaacaggagaaagatgttcaagcgctgtgcgctgtggtgtatccacgacggcagccctgaaggaccctcgttggcgcctgaaagataagttaagacttgacccaccagctccggtggcaaaggcgtgtattttgtcaataaggcctcggcaacattgaaacgttcttcgtgactgagataggacgctctgtcggtggtaaacggcggccggtctggttcatagagagtgaggccaggatcgtaatatcgatcgcgttgaacgttatgcatagcagatttctttggtggttgcacgttgcgtagtttctgtaggaattcggcttcgctgctcccatctacagtggtccgctttgcgaagacgcaaaaatcgcccgctggggataaggtagctggctctggtttgacaatgaccatgaccagtgaaagaagtgggtcctcccccatacgaagattcccatgcagctgacgctgggtgaggccatctgctacaagaaatcttgtccatccagccctatatgccaaggtagccgttgcgtgaatgttagcctggctgtctgggtaagagccttggagggcgacccgacatagcagcgccggtgacggttgccatctcgtgagtgtaacattttcctttccgaggaagtcttgtaggcgaacagcaagataagcttgttcggctgaagtttgctcagccaggtatacaagcagcaatggatacttgccctcctccttctcgtcgatcaaatgtgggagtccatacgtcggagcggaaagcccggggccgttgtccgaaccgatatgggcttccatctgttctgctcctccccgatgccggtgttcttctgtcaggaatggagggctagagaagggtaggcggatgaagatgggggtggagaaccaagcaggcagtgtgggacggtcgatgaatgggattgtttccaccgacagggaaaaggataaattgcagtggggaactcgtatggacccggcatcactgaagcacgtggcggctgtcggtgcatggagcttgagttcgcagacaaactgtataccttgacgtagctcttattgcggatcccttgggaggtatgagttggaaagggaaagaggctatagccaatgcagcagacaccagcagacacctccgtatgcgaggggtatagagtcagccatgatcggtgcctgggaaattcggcgatcagagccgcgcttgacttccgcccgccattttctcgataagacaagcgaaatgccaccgcctttgatgtaagtctgcctgaggcaccaactatggtccaggtgcaaagcctgtaaactggatctcaaggttctttcagtggatctcagattaacgcttcgagttgtctataagtctatataggtgaatagtcatgttatcatcaaatcctcgtccatcgatatcagtatcccaagcccttatcaacctggttgagaagctgctgccctcgagcccgtctttcaaaattacactgcagtatcttgatagcacggtcgttatagtgggttgagttcccactgcaatgcggcgtaataataacatttttataaccccacagcttatggtcagccggcaatggctccggatccgtaacatccagggccgctcctcggatgtgacccgcatccagggcatccataaggtcatctgttttgatcactgccccgcgtgcaatgttgctcacatatgccttcttcttgctgagatgtctaaactgctccctcccaatcatacctcgcgtctctctagtcagcgggacagtgatcaccagcaaatcgagatccgaacctaggaactcgttgagttgatctttgcccgagaaccacttggacggaaattgaccgtcttcgtcccccagacctggctcgctgaatgaatctgtttttcgggactcgggcgtggttcgtgggtggagtgtgaaggcatggacattcatgccgaaggctttggcgacccgggcgcattgccggccgatacttccatagcccattattccactgatattgtctcagtcgatataaggtcgatagaacccaaagtcagacttacactctgagaccaactgcatcctcggtgtcttcgtccgatgtgggatcgatccattggccgagcttctggtgctccagatatccgggtactgttttatcgtcagtgttatgttcctttcattggcgtggtcaacgtacgatggtgctggaaggcgaggaatgtcatgaaaacccattctgtgatttgaggtctgatccgtcagtggaattccttctttcacgatacttctgagataaaacccacggatgaaccccattcgctgtacaaaacgcgacgtcagtctcagcgaatagcgaggtccccataacatgattgcacccggcactcaagagctggacatattgtagacttgggaccagctccttgggcggaagaagcttccaagtaaagagtgctgtaacatccctccatgtcccgggggagatatctgtgggcagctccgtagcattcctgtcaatttcgcgtttctcgatgcggatgtgggggacagcgctcctcatgctggcaatccatttgtctggaaaagcgcacggcatgagaattaacaggaattcctgggaggccatgataggatatctgggagtttgtgtagatccagaagtctatggtgttgataatgcgagaacaccgtggaggtgctgaggtatacatacggtgagaagtgagggggcgatgatgcgttatcaatgcgagataagaagctgtgctagtatcaggctcataccccgcagtcattcggcctatggggccaattatggaacagcatttgttacacttcgactcacttcggtagtacagaggagtgcaatgttatgctgaatgtccattggacagaacccgccagcaggtttccccttgacgatgaagactattcgagatatcatttaagcctaaagcaacgtggcagtagatcaaccaccaagcttgaggaatgggtgatctatcaactcacgagctgtctttctctcctccgggagccaggcgagcatctgtctagcaaaggataagaatgtttttcggtcgttcccttccagaaacggagttgtttcctcgacgcctcgggacggaatcaaatcatcatacagtaatttatcttgagacgtcagtactatgcccatatggcagcggtaggtgaggcgaccagtttcgtcatcaactttgcagtgcattggttattgttgttgctgctgctgtcgatcaatgaagctggttagggtcttctcactttcaaaggccatgagaatattattgttagtcgccttagaggtaacgttggctcgactagactgctctgaaactgatcaggaactacaggcgctcttgatagtggctaatcagaagactgatggggcttgactaagcgccaaacacgactgtaacacgggtgatagtatctgagatggacctacacgcaatgggttataaatacacttaaaactagactgagcggacagttaagaaagtcattccaggagtaaataccaattactaagtactactatatcccaggttgtcatgaccagtcagcggagtcggaaccatagtaggaccgacgctatgctactattcttagagggagtcagtatacttttacaccgtgtttaggcgaaggcagatgtgtttcaacgctcttttcttcgtattgtttgtgggggcttctcttggcaagtatgggtaaatacaagcaatagtattctgagatacactccacggctgctgtgagagagcctcaaaagggggagggaaatctgacagataaaatcaggctgagtgagcatatactcctagtagtagtaggattccatagtaactgggtcagacgtaagagaaaaagaaaccaatccaatcagagggatggaatgtagatcgggatttgaaccatctcgcatgccttgactgcggacatgtccctcccgtcagatcagaccatgtcagttcctacttactactacatacatacttagtgctaccaacgtactcctactcataattagtgtttaattaagttacagtgggttggaaggaagagaagcatcatttaagttcaccaactcgcaaactgcagcaacatccctacataaagttctactagtctggtctccaaaagggtctctcgctgtatgcctcgtgatcggcaaccccctccatgtgacaggcccgatcgggatccacgttctctgtcagttccatcttgacaattgcttcttcctcttcttcctctctgttttgcttttctctactcgcactcctcctgcttgtctcattttctcatacgttttgcctcttttccctcctcacttgcggtaactgctgcctctttcctgcagcctgcctgactgggtatgattgacgacctcttggccttccccctcccatcccatctcggtcctgtctggtgttttgcttatttccttggtaccttttggcatataccctccatcttataatttgttcaccggccaaccatccctgcacccccaagaagtagtcgtcactattggtggtgttatttcgtggtgttacttggtgcgacaccgcccctccacctcgggattcttccatattcccttctgtccgccttccactggcttccctctctgtctttccttccttctcatcccacacttctaagccacccaccaccaccaccaccaccaccactactactgaccttcatggttggttggtcacacaacgcacaacacacactgactctttgcccatttcttgccagttagcgcggtgtctgtcccacacttggaagtctacccaggcttattcctcggtgtgggggaggtgggcaaacgccctgcggggtgaaactcgatttatcggctgcagaagtccagatccgacggggtttgcgatcggaggccaaacaacgtggaccgaccggccctcatccctgtgcaacccactccagtgccaatcacggctgatccctcctccgtctcgtttccttacttaaattccactccctgcttattattcctccccaccgctcgccccaatcgaccggtggccagccccgttgccaactttgcgccctgatcggaatgcctggcccgacgacctccgatttcccttcgtcttcgtcgtcctcctcctctgcctccgagtcctcctccagcacttcggtcctgcctgggcccccaagcacccgcgcccgcagcccgtcagcatgcaccgtcccccgatcctcccatccgtggaccccagacagtctgccctcgcccatcgcctcctcgtcgactcgggtgcagatgccgtccgtcgaagacccagcgcccgccgtcagctcggacgcttccgaggcgggcatccacggtgatacagacgatcggaacacgagcgaattggccgcctccgccttcatggccgtcccccagtatacgcatgtcttcgagtcttccgatcggccctatgccaccccgtccgaggtggtgaatgcggtgagggcgcgcgacgatctactggtgcgtgagactgtgcccgaccatgcgcccaacccgtcgtcgcccccggtggaatggtacgtttcggactcggaaatgacggacgcgctgtcggagatgggtggcgtcccgctggagccctacattggcggacacgtcggcgtggcagccctcctcaatcagtcgctgggtaccccggtaaccgtgcaccccgtctcgtccacgatctccagcgacaccgaagatggagaggcgaccgatctgatcatggactatgagccgtcaatgatggagaaccggtccacgtcgcagtccatcgtggaggacgacccggatgatacccaaaagttctactcggatgatggcgatgcttacgaggacgatgtcgccagtgacatggaaacccgacacggcacggcgtatctgtcggaggaagagctggaagacttctatcacgaccaacctttaccgtcaggacctgaatcacttgatctgggggccggttcaatgcgcgacgattacagcaatgtcttctccgaaggggacgattccagcaatgccgatccgacgggcgagacgcactttgctgatcctgtagttggaacgagtatgtccccgagttctacgtcattggtaaaatgctaaccagtgatagcccgcgaaaggaacctgaacgtggaccagtttattgcccagtggctgtaccagtcgtccgcagcctcctcgatccccagtctttcgatgtcgtcggcacaactcccgcgcagcgccattgcgcatttgatcggatggatccctccgcccaaaatctatcggccgccggggtatacgcgagatttctacgatctgcaacagatcccctggtgggatgccttgcggatcaagcgggcatatgtgcgcgagctgcgggaccagtcatacacatcgtaccacaacctggagtattcccggcaacggcctggcgcgaggttgccgcaggaggagtcgtacttccggggcaaggccatgtacacggaacacaaagccaccatcgagcacttccagctccggaacctgatgtcggtggcggcctacaataccgtccactttgcacacgagtcgaaggtctactcgtgggtgcccgcgtatgacgatctcgtctgcctcctcgatctgtcccggccgacggtcgagtcggggttgcagggccccgttaagatctcgacgatgaagtcggcgcacgacacgaccatcgcgggcgggttttcgggcgaatatgccgtgcgagcagcgggcacgacgggcccgggcgtgcaagggtatgtgaccaaggacgcgaatggtatcaccaaccatgtcgacatcattccgagtcggacgaaccggtccccacaagggatcttcgcgtcgaatgaccgtcacctgcgagtgctggactgcgagaccaacacgtttgtggcggaccacgagctctcgcgggccatcaattgcacggcgacctcgccggacgggcgcctgcgcgtgctgattggcgattcggcggacgcgtgggtcgtcgaagcggataccgggcgcccggtgcaccccctgcgcggacaccgcgatttcgggtttgcgtgcgcctgggcgcccgacatgcaccacatcgccacgagcaatcaggacaagacggcgatcatctgggatgtgcgcatgtggcggatgctccagaagatcgagtccgatgtggcaggataccggtcactgcgctggtcgccagtgggcggcgggccgcgcaccctgctcctgtgtgagccggcggaccgcatcgctgtggtcaacgcgcagacataccagcgtcgacaggtgcacgacttctttggagagatcggcggcgcggactacgcgccggatggcagcacgatctgggtggccaacacggacgagcactttggcgggttcctggagtacgagcgacggcagtggggacaacgatacgggctgcgggatcggccgaacgagtggctgcgcgagacagagctggacgacgacgaccgatgcatgttgactgagcgagagcgacagcagcgatggatgtggacgctgggggacgaggagcatgaaacgttgcttttgtagccatgggtgtatgactagtgcattatcctgcattattgggcggagccgtgatttagagataccatgttacttgccgttttttttcttttttctttttttcagctatacctcaacaaacattctattctccaactcattacttcatgataatgataataccaagtgaaactaaaactaaatcacccgatcgtggctgagtagccctgccccactgccgatccttccccattcctttctttactttctacatctacaccgccacagcccctcataaatactcctatcctacccctccatcatcatcccctcatcatccatcatcatactaccttccaaccacccaccaaacatccacttcgtgaagtaaacgaaatcagaatgtccttctccaacctcatctcctccgccctcgaacaagccacctcccactccagcggtggcagtggctccggctcctacgaccccgaattctcctccgcacaacaccacgcccaagcccacgaatcctccggcgattcctccctcttctcctccgccctgggcttcctctccgaccgcaagagccagtactccgagcagcccgacatcgacgaggagcacctggtgcagtcgcaccagcagctgtacaacggcggtggtggaggatacggtcaggagcagcagcagcacgatagcaagagtctgggtgcgggtgccgctatgcaggcgctgaagatgttcacgtctggtggtggtggtagcagtggtgataagaatgagtttattggtatggcgatggcgcaggcgagtaagctttgggaggagaagagtgggtctggcaatgttgtaagtgttgattatttgattcctcttttggtgggggggtgttggggtagggtaaagggtgtgggctaactggtggttgggtagtctggcgataagcagtctgctgttaactcggcggcggagatggcgtttaagatgtatatgaagagtcaggggagtgggtcgagtggtacgggtggtccggcggcgttgatgagtctggcgagtaagttcttgtaaatatttctaaggcatcgggttgatgaggatgggtttggtaaggttgtgagattgtttgtgcatgtgagatgaaactaggaaatgcatctactaggatatgcagtgctatacatgtctattttatctaccgggtatgcttctagctctcatgctcagtctctttcttcggtatagtaaatcaccactcgtcatcttcatcatgatgtccctgcatcgcgtgctgtcgcgccttcagcgcctccgccaatcctcccgccagactcgcgttcgacgcgctgtttggcgtcccccgtccactgcctcccgacgagtcgtgcgagttcatgctcactgcgctatcacgtggcgccgcggggggtgcgggcgccaccttccgccctgccatgttgggccgcttggctggcggggccggcggtgcgggcttggccttggctttggcggccacagcggcggcggcaccattagtcgccggcacggggctggcgcggggtgcggctggtggcggcgggggcggtgcaggcttgggtgacgctgccacttgctcctccaggtaggcttcgggcgtccagccctggaccgatgtcgtggtattcatacacaaccaccatcctgcagacattagctgacctgccgtcgagaataatgggcgggtgtgacttaccatttccttccttggagacaatctgcacaagatcgcccgcccggatcgacagttcgttggactggtcgctgttgaagtcgtacaacaccttcgccatcggcttcctctgggctgctgggggcgtcgccgggggaggcgggggcggcgcccttgtggaactggaggatgcattgcgtgtgtgctgcgctgcggcaaccgcggcaaccggttgagggaccggcctgggctgcgctgcgggcgacacagctggccggggggcggggggtggttgcacggcagccggctgcggcgtgggctgcggcataggctggcgcgccggtgcaggtctggatgccagtttcgaaggtccgccgccaggaccgccggggcggagcaacttgcccttcgtcacgggtcgcgcagcaacctgcttcgggcgtggcgtgggtttggacacggagctaggcggttcacccgcactcgtatggatggtgctgctcttgtagctatcgacgttcgaggccccagggtccttgaccaccttgacggtagccagcttgcccggcttcttgttgtattcgatgctaggaagaattagtggcgctctttacgaggacgaaacacacttactggtcggcaattttcaggttcagctgcccccgaagggcgttggtgaggtgtgtgaagaactcggtcttgaagacgcagttcatcagcgggtctggctcctgtccgcccaccaccagcgagaaccagtcgtctttcaagttggatgtgctgacggacttgatcgctccgataggtatcgtccgctctgacgcaatctgaagctggttgttgaccagcgtttgtgccacgatgtagacgtgtcggttggtctgcgttgtcagctgcgtccagttgcagcaaggagcattcgacttaccaaaacaaagatgcgcggtgccggcttgctagaccggccaaacttggaaatcaatacttcaccacggcaagagaagagaatattttccgatcctagcacttgtcagtacaaatcctacacgtaaagcgtgtggcttaccgttaatgcctgcaccgttgtggatcatttcgcccgggccacccttgttgccaactcccacataatctccgaggaagcgccgcgacccgagcaaactcatcctgcgccgctccttcttgccctggaggacctggtgtccttggtcacgtagtttaatgaactccagaccgcctgtcatgcgacgccagaaccgctggatgcggatggcgcattcgatgcggtagcgcaggtagttgcgccaagcacgctggatgcgaatggccatgttgtgccagtaccggtcgcgcatcgtctccaaggcaaatagcgtctccggcgtcttgacgaacaccttggtgatacccatctggtactcctccgcggggatactggtgtctttgaggatttggcgggcgccagactcctcatcacccgtccacgtatagtcaccagcgtacgaggtcttgggcgacagcaggtagaagcgctccacgaacttgtcgaaggtttgacggtaggcgaaaccagcgcgacgaatacggacgttctcctgcaaacccagatacttgatctggtgcagcacattcccttggttgtactcccggggcgctttgttatcgttgggcttgatggtccgaatgtaagatggctgtgccttcatcagggtcgccacgaggtcgttggcagaggccttgattttgtcgctggcggtgggaggacgtctcttatcatcctggttcacctggttggggaagagggtgtgcacgaattggttgctgctggaacccgcgaggttcaacaaatccttcagcaactggtccttgttcttgtcggtcatgccctcgactgcatagctgacgtcaccggcgtagtgcttgacgatgaactggccctggcggctctcaaagttggggttctggcccaggaagttcagacggccgacgaatgtgttgtccgccgcgcccgagtcggcatgcgctgtcgcgcaggcatcgttcagcgctgcaaagacaccaggcggacgcttgtcctcaatcaacgagcagaccaccttgttatcgaagtatttgatcggggtccactggatctgttcccgcgcatactcatcctgctccgccttcagggtcaactggatgaagatctgttgcagcttctcatttacgtagttaatacacagttgctcaaacgagttcttctcaaaaatctcaaacccgtagatatccaagataccgatggagttcgccacagaacctctggcggtcaacgaagagttgacccgcccaacaatccagtcaaagagattgaagtagatcgccttggacaacgcatcacgaacagctagcgcctgcaccgtgttcaaaggaacctcatagacagatcccctgcggcctccgcgggccgtctccatcaaccggatggtgagcgccttgttcacctgcgcggcatcgacctccagcaagtatgcgacaaagtcgaccaccgactggtcggtaatggcagcgttcccggagtcatcttcggcgaactgaatgtttccgatccacaggatcgcagccagcatccggaacacctcgtcctgttccgcttcggtcataccaatgacacccatggcattgatggtgtctctaaattcggccgcatcatcgactccggggacatcgtagcacttcgatcggctggtgtagaggtaggactgaggctgctgtatgccgaacatatctaccacgagctgttagctcggccacgggaaccaggattcatgcgcctacctctgtacttctgcggtgcagctttggtgaactggtagaaaatgtggaagtttcgctcgtttgtgatttgtcccaccactcttgacttctccagcaggtagtttgtgatgttggcacccaccggctcgccattggtgttgaattccagttccaggtactttccgaaccgggaggaattgttgttgcgcaaggtctttgcgttaccaaacgactccagcaacgggttggtggccaaaaccatgtcttttgtttgttggatggacgagtcgctgccgccggacacactggcgatgtactgcatgatccgcttggccgcctccgtcttacccgcacccgactctcctgagatgatcacgcactggttatccttgtatgacttcatgttgtagtaggcggattctgcgaccgcgaaaacgtggggtgggacttcgagtcggttctttccccgataggactcgaggacacggtcggtatagatgcccactagaatagggggggggcgggcgtggtcagccatgcgaccatgggtaattctggcgcttcaggggaaaccacttacagtcgcggaacgggttcacagacaccaacacatgtccaatgtatgtctaccgaggtcgtccgttagtgattgtcctagcctagatattcttgccattgtggtggttgtggtggtggtggtggtggtggcagcggcagcttacgtagatctcgtcatgttcgaagcggagtttgaggttgtcattgatggcctcgttggagattttgctgaggagggtaagatcagagacaccaatctccttcttctttgtgctttcaaagacggccttcttgacctggggcttgcccgcctgtcgcccgtcgcccacatcggcggcggccttggagcgaccgaagccgcgactcttcttctccccgccagccggacgtcgtgaatgaccctacaacgagacatggggttagtagaagataatttattacaaaagtataaacctctgtcatcgaactggcagtgaaatgggccgcgactcaccatgattgtggctaccgacttccccggaagttgcgcccaagcgtcacgatatctggcctatcagtctggaaaggaaccgggcggataaattcacagcggatacggaatgaacgcagcgggcgtatggttcattccaagaagctagtggatggtgagaggggcccgcacgaaaggataggagtgtgttaggataatggaagaggggtataggaatgcgaagaggacgaggggagagagaaggagggagggaagaatgacggaagggtgccttgtggaggaggaggaggagagagaatggggaccctctttcgctattctaagtaaaggcagagagagagacagacagacagagagccggtgattcggcgggccggccgatggagcctgcgccacacttgggttgcgctgcctcgaatacgcgcaatcagtctggccgctacccgaccatcttactagtactagtcagctaggattggtagtaccagagctaaggagtaccagagtttctctagttagtaactctaggactctggcagtgtactgaacacttaaccgtaggtaatctactacggatgtacttcagtggtactttagtatgttgttgcctccggggcaaaatccccgagcgccagtcgcccctgggattcgggtccctggcgctaaggtttccagtgaaagggaaaaggctggccgcacacgcccgtccgaggcaccgacgatccaagggactcttctcgggagaagcctgaggctgccattgccaacggttctctttcttttttcttccctcccctcctctcaccctcactacgtcaccccctgcagcccaatgcttgtccagcttatactactagtagtgactagttagtcgctccttcaccaccaagctgatcccggatttttccaccgtagtatctgccacatttcgtcaattgcattaataaggggctaacaccgctgaaaattggtgtgtccccgtcatagaacccctggataggggagagtattcttggtaaacgaatacgatccactcccgaaatatattttgggtcgtttgtacctaacatccccagcctgatatgccttccttttagtactgcacacaatcctgacttggaactacaccattgggcaacgagacacgcgtgacatcatcctgtgcatcacttctttagagaacagctgcattgggttgatctccagaccccttacaataaaataaaggggtgtgattattgtgataatactcccgtacgtagttgctgatccttcctatactagctacgtgagctacaaaccagcgaatttgctgaagctctgtctgccctgctcccaagacgcactggtagagaagaatctagatcccgcaaaccccattgtgttcgcagagtgttgttgtcgtcgttgttgttgttggttatctcttgtctcgaggttggcgatatattcttgcacagaggccaggaggctatccgcatccgcgacaggaatgataggcagcatgtttgggagggactcgatcatcctgtatgactctcggtagtattagccgcagatatatcattttcactagaagatcagtgtgatggatgctcgtacagcgcttgcaatgctaccagcccatccagacgatatctcccacttgcactatggaacgctgtctcggagagcagaaatgccacggctttcttgctgataccacttgtgtgggcagaaagttggcgtagtctagatgtagtctcttgcgtcacagacgattcaatggatgagggtgtcaacaggaggatgctcagtgtctccgtctcatgacccaggcggatgttgaaatcacatccctctttcacttcacctgctgtaacggtatcagaggagaagaggtcaatcatcaacggaactctgccaaccttctaaacccggcgacatcctcaggatcggctcaagcattttccatacagattgatcttgaattgaagagcagtaggtgcctcgaagtgaaacccgcttgtcgggctccatccggtgtagtattcgaatgtggatatgggtatgtggaaagtaagctcaatgaagagaggagtggattatatctatatgcctccgcttgtcgctccgaaaccaacctctgcgtgccttgccttcctctttccgtcatgtataagggtatcgctacataattaacaagataatcctccacatagtgccccaactgatctataacaatatatacaggtgcataaatctaatactggcatcgatcaagcttttttcgactctggcgctttcggttcaggttcggctggtttcgatgccggcgacgtttgtgcctcaagtgatggcttcgctgcgctcttactttccttgatcacagactctgcccgttgttccggactctccccccaaggcagatacgacgtaatccaggagagcaaacccggctcctcagctggcttcacttcgtcctcttgatttacgtcccacacctcacgaggtaggatcctcgaggaggactttggaagttccccaagttccccgtgcttggctttctgctggagcagctccttctccaaggccaacagtgctagccgagcggccttctcagactgctccagctcggccaatcgagtctcaacgtcctccctgcgggttgtttcctttctccgcgaccgccacgactcaaaaacaatcagtcctcccgccactataaacaagaatgtttcgctgatgaatgtggcaccagactcgatcgccttggactccgacaatggtcgaatgtgaggtttcggtgccggcttcgctgcctcctctgccgccgctttggctttcgcaatggcttcctcttccgctttggcctctacttccgtcttgaccgttggggatgtgggtttgtgttttcggagctctctttcagcagctgctcgtttttgcgaagcggcgttgtcgcggatgttgcctagccggagacgcatgtcgatacggtggagaccttgcgccatggagacgcagatgcgccggaagcgttcatgttcgcgagcctgggccttgatttggttctttggggtgtcagtcagttcctgtcagcagcacatcactgcaagggtggactaagcgtacggcgatcggctttgacaaggtgcggatgacaagggaggagagcttgagggtgagagacatggtggatggaggggagggagaagagggatgttatagagaacaagaaagcaaatcaagagctgattataagcgacttgaatccatatgacattaacgagaggtcttaaaatagctcttcacatgggtctggaagttggtcgaagatgatccacaagactgctgactcgattgtcaggcatcgaccgcagcgggattcgtggggcgcatagccgtgcataacgtgccagcactgtgcctgctgaggtcagcaatgcgcgttggactggcattcggatcaatgtttatcgattgccgcatcgggaagttcgtttggtctccatccgggaagctctccgtctttgcttctgtctatccctacttcactttcctgtcttccccccacctctctctggtcgcggtctccctgattggagtgccattgattgcatattgttgtttttgagcgtcaattgtttgatattcgttcatttttagtaagtatttgttcccattgcctcactatctccccctcggcgctgcggtgtcggtgttccatcaccgtgcagtgaaaccccctcacccggtcgctgggacccggcctcaggtcgcataacttcatttttgtataggggtgctgacagtctgttaggagcacaagccaactagatccattataccccgagtgcactgtacccctattgatcgtttatatcgtctgagttgatgtccgctacaagtctggattcgagatcaccgccgttcctttgtcaccaacattgatacccaatcacatcaaggcacaaggagcttccgaaaggcaagatggaggcgctatcaccccggtcgacgaaccaaatcgtcaagcccaagatctcaatggagcgcaaagtattggataagaatgctgccgctgccgccgctgcccaaaaagcttcgtcgtcaaaaaaccatgcgccgccaccaccatcgctgattttggagccggaagaggatggagagcgatactcgacgggcgcttttcttggcaagggtggctttgcgatctgctacgaagggacactattgcgaaccggccgtgttttcgctatgaaagtggttcgatccgaaatggcacagaagaagatgcaggagaaggtatatataacctaagaacctgtttgtgatgctgcgtaatcgcattgagtatgctgaccgatgatcacagttccgcaccgaacttcagattcactcgaagatgcgccacccacacatcgtcggcttccatcgcgccttcgtcttcgacagcagtatatacgtcattttagaactatgtccgaatgggtccgtcatggatatggtcagaaagaggaagtgcctaagtgtgcccgaggtcagacggttcatggttcaactgtgcggtgcgatcaaatacctacataaacgaaatgtagcgcatcgcgatctgaagatggggaacttgtttctggatcaaaacatggatattaaagtgggcgacttcggtctggcagcaatgatcatgtctgagaaggatgagaagaggaggaggactttgtgcgggacgccaaattacattgctccagaagttctcgacaagagtaaaggcggccatacacagaaggtcgacatctggtctttgggggtcatctggtaaagcccaagctaatttcgtctctaaagcgtccatgctaactgcattttcagtttcgcgatgctcaccgggtacccgccattccagtcaaaaacacaagaggagatttataaaaaggtgcggaacttggcatacgtatggccgaaaggcaccgagtgcgccaactacatcccggaagaggcgaagtcgctcgtgagctggtgtctcaacctcgctgaagaagagcgcccggagccggatgacatcgtcgaacatccatttttcaggatgtatgacggctgcatacccaggcgacttgacccgtcctgtagcgttagtaggcctgtttggctaaagccagatgagccccgcggcgatcgaatgatgtttgggagcagcttggaatacgacgagaagttgtctggctacatcgagcacatcgatgatccgagtcagcgatatctggtctgcagggcggcgttctacacactctgtggcgtgggcagaaaaccagacggtacagcacggaaggccgccggaaagaattgctcgaagtcggcatatgctgaatgcttatccgaggaggagaaaggattccagcctgtcatacccctcccagaggatattgtgtacaggtacccccatgacccgataggtgactggagcgatcctgatacttccttgctgtcgcgcagagatggctcctccttcgaagacagtgtcctgtcaaggaaaagcagcgcatctgctcggagtaatgtggcgtcactaacgcgaactcaagcggcactggctgctgctcagcagcgccgaaaagaatcgcagagtcatgccgcgactctgcggcagcaggcagctacaggcagagggtctgtccggaaaattgcagctatctccgatcccgtaccgacggcaaaggctttgttcgaagaaaaagaggcagaagcaaaccctgcagttataccttcaggtggtcttgcggagcggccaatccgcgcacggcgtggtgtggcagcgtcgtactcgggttcgttgcgtgatctagacaagaacattgcgccacagatacccaagtctagtacggcaccggaatctttggtcattggaaagactcgctcccaaacccgctcccagacgcgctcgcagtctcgcagattggagtcaggcagccaggaaactggccctctgccgccccctgccaaagaacggcctgcatccgtagcaatggatcaattgccagtcagatcacgccagccttcgcaacggtcaatgccaaagtcagaggccagagatgtgctcaagcaagaggagctgccgaaaggtgccacgacaaaggagactctgacggagaaatctgtacggcctgacccctcttcacaaccactcagtcgtgctggtagtaagacagcctcatctgcaagcaagccacgctcgacactaggcctacaccccttgttccatgtggaagatccatgggaagcgctaccaaggacgtccctcgatgacgtgaacatggatctgcggcacatgctggccaacatggtaccacactccgcagcccggagacgggcagggcttcgacgaccacctcatgcatatgtgatcaaatgggtggactacacaaaccggtatggtatcggctatgtcttggatgatggcagcgtaggatgtgtcttcaaggcagagaatggacagccggcaagtggcgtagtagtgcgggatggcgaaaaacacatccggcgcaaagcccgtagccaggagcaacaagagggagcgatctatgggtattccgaggcagaccagctcattcctcgccatggtaagccggtagaattctacgaaaattgtacccgcgacttcaccgagtgccgcggcggaattaggcgagccttgatctcaccgtcgttgttcgaagtcaaggcctcctccagcggatcttctgcggctggtatcaagatccgcacgaactctggtcttgactgtgcacgtgcggacgctgaaaagatcaaacgagtgaagcttgttgaccagtttggtaaatacatgatcggttctttaggacgacacggagatgaggcagctcttgaggacgagttggcttccggtagctcgggccaattcatcaagttctaccagcgactggggaatgttggcgtctggggatttggggatggtgccttccaagtatgttaaccatctgctacatgtcgaatgtacctactaacactttcaatagttcaatttccctgatcacacaaagctggtgatcgctcctggacgcacaagaagctcctctccctgggtcgacttctaccacctttcaccctccgcagcgagatatctcagcaccaagggcaagatgcacccatcaggattcgacactcgggcagtaacatcggacgaagttgcaaccttcctcggcattgcatatggcactggtgcaagttctgcagatgaacgggttcgggatatcctcgacgccaattcctttctacagaagatcaatttcattaaggaggtgatgaaagggtgggtgaagcaggggcgccttggaggacgacccacgcaagacaagacgtcaggcgctgcaagccctatggaattgttctgggagggctcccaggagcgggcagcaggaggaagcggaagcaagttcgtgtgggtgactgttggggcacccggaggagatggagagtatcggtccgtatcattgagagaaagaaggtcagaagctgaagaggaccgcgaggcggatgtattgagggagcgtctccggatgctgggcagaccactgtaggagctgatggtctacctttacgatgtcatgacaagcctgttgattgagtttgatatttgcatggtatattttatggctgggatggcgcagacgccgtgtcttggttggtttatatcacttgttgtgtgcattcgtgactagtagtacccccatggtggtggttaataatttaattagatgactactacagacaggatgacatgtcccagcgactactgtcaagtcaggactctttttataccagttcactaaatgtagagtcgtgatgcactggatgaggcgatgtgcttgacggcttacatggcactgccacgggatttctgattggtggcaggaagtagcaatctcgtacattcgtatttgctgtggtctagtatgtcaaaccgcgcccaatgccaggcagttgtgggtgggccatcggactttatggcgggtcaacttgagaaacctggaaaggttaagtgtctcttcacgtggaacccctgagcgccaccaggtattgcgcattattcaacggctgagagacttcctggtagggcttgactggtggctacgaaccatggatttgagggatatgccaagctttgcaggcagcatcgtacgccgcattgtacatacactcgtgaattcgtttcgtagagggagaaagggccctcattgacgtgatactacatagatctcggacataaaacagcgttgctcccagaacatccgcaacagcttgttccacgttcaccattaaatatcggactaaaccttgaaagtttccggcaggaaatcggaaccatcatgaacttcgctcatgctttgatcttccttggttttctctttgcgattggaatctgttctacctttcatcgctgaagaaatggatcccgtatctgtcgcaggcaaatattaatgccactgtgtatcagaggctgttggaaaacctacaaaatgcagtcaatgatcatttatggagcgacaaactccaggcctacttccactcttaagcataccaagacttcttttcgcaggatgccaatgccctggccatcctgagcgatactacacaccttactggaaagcgtactgctgcattattgtccaccatggcacagcagttatatattcccaaaggcgctcttgccttctccaacgccagcattgccagtggcttcgcctagcagatcagcccctatacctccggctaccaccttaaagcagccttccacgcgaacgatgccgttaatgccaaaagtcttcttcacagcgtctggggcccgatgagtgacccaaaacatgccaactacactggctgtatgtgggaggtcatgagtcctgatggtactcccgggctcgggtccgtaacctcgctgtgtcatgcctggagcgcagggcccaccgctgatctgagccgttatgttctcggtattcagcccgtcactcctggttttagggagtggaaagtcgcacctcagactttgggtctggcctgggcacggggagaatatcctacccctcacggcaacatcattgttgattggtctttcgactgcagcggacatttcaatattgctcttcgtgcccccgttggcactagagatactgttgttcttcctagccctttgaacggaacacttgaggggcaaggtggaaaggcatttcgctacaaacaacatacctgatttcatgagtagatataattcggaaatggaaggtgtgcttgaagatactaggaatcagtgaaattcaccgattcatacacgtttgcggcttcttttcgaatccaacacatggccgtatcaaggagatgggattgctgaaaatccacctgtttcaaaatgcgaactcccgcatcacctcgccgaaactaccagactatcagagctcaaccagagtattggtatatcctttagcatccattaagataccattcctcagagccacaatggaaatgagatcatccactcgaggccccttggaattctattcgaaatccctgaggatagacggacatgggacggatatatttgctaatgccaaggagcctaaattttattggggctgggatctcgaaactttagatcaagagggtctaagacctctaattgttcgtatattcgtaaattcgtacttgcatgatccactttatggggattacccgctgggtgaaccttccttacccgattcaagtaaagccgccccctcaaaggccaagctgatttgctactctccgagtctctttggccttttgttttgtgctcgaggagagccttattaagtccgggaattggagtctaatgattactctcagccattcattgtataaaataatggctttctatcctcagcgtggtccttccagcctggtcgcagaatgattttgcaagtagtatatcatgagcatacggaaccaagagtaggcagtgagcatcccgccacgctcgtgcaggcacctgctattatgtcaatgtaattcctattcgctagatggctctgtattatagggaggtttgcgagctactgctagaggatagtgtatgtgcattcgtaagttctaagcgccaaagtcttcttccagagaaaattcatcattcggcactacggaacaggccatccagataagttgatgaccacctggaaagttccctacgagtctatcgaattctccccaggagaaaaagaagttatctctcggcaaccctacgtgccactaaatgcctgacatccagtccggtattgacatgtctggttagccgaacgcggttatgagttgttcagtgtttctggcttggaaagccaacctttggaatttgcaatgctctctcatacattgtaattcattggtccctgatcatttagcttgtttcatttgacgtgatatggtgccgggtctatgccaactaacaaggtattatgtatttgtggccgaactccaaatatagtaaatgcatcgccacctcagcggctaaccctctgcccggtccactacggagcagccgcgcccaacgcatcatatgttagatgtaaaacatatcatttataaccctcgaggttagatatctcaagttaaaaatcattagaatatatcagcgagaatggcagcaatactcatagcgttaataaaaatggaagaaatagaccacggacatgatggaagatgaaacaaagtaagggggaacgtcttcgctcagtgttgcgagagaagatctagtagctaatggagtgggaatagaaaatcagatttgcaaatgactcatttgagaggacatctcactctttggatcattctcctcaacggagttgggtgtcatggcgcgtaacggcgatgtaagagaagctttgttaagacggggagaggggcgtgcaatcttcctgtttctcaatttttctgggggtgcagtccggggaaattctgaaacacgttctcgaggcatcagtctaccgttctggtcttccggtggcggagggtgaatattgtagcgttcaacagaatggatttctccttccgcatcttttacaattcctttcctttcaatgagagcacggcaaagctcttcgagaaatggatatggaaggctcttctgacaactcgtgaggtgctcttgggttgcattccgtgcccaattatcaaccagaagtaaacgcaacggagactgaggcaatgtatggttgtagacgtaatcgatatcatcacaactgaaagttcggccagggactttggcaatctcagttctacagaggtgtatcacctgattctgcagtcgggcagtctcgaaggttccagcaaggatccaaagttgtagcaagaagtgaatgctagtacgagaaggcaagtcgataggagtgtcaccataatacatccaagctaacagctcggcaaagacaactggatcctcatccggaaagcagacagggtcgcttgggatgggcttcttagtacgatcgccgtatattgagtcgaagtatggagagcaactacacaacaactccacgtgaacatcaaatggagtctcgtcggctcccacattaatatgtaccattccggcactcagggcactaagattatcaatcagtatgtaattttgaaaagctgttgagagccagcgtacaacatcccaagagatcgggacatctcctcaagagtctttctagatggctgtggagggttctggtggcgcctaaagtaatacagagagaacaccaatacgatgcttgggtatcaagaaccaagattatagtgatttagacttgtgcgcagaaaaagacacgtccggcgcattaaaaagccgtggtccgttcagacgagacagaatttcgagtgtgaatgtccagatatctttcgagcgcgaagcggggatccagccaatggttattcattagtgaaatgtattgagtcggatcatagttttaccgtcaagcccgcctaaacagttaaacaacagtacaagatagaggggcagcgatcagtatatgaatttaagtcaaactttgaatcttttattaaaacccattaagtgtaccgcggtcgttatgccattttatttactggcaaattcaatccagagcaactatgatcctttcttatggaagcttgctatattactgtttttataactataaaatatatatttctaaatactagctgtaactcattatgaatttagcagataagtaagctttaggagattgcttattggatcgcaagactacattttatcaagcgggctctaggtccctagacccctggtctaccgcgttctaggtccattacgagattcttcccggagaagagcattccagggttaaagtagtaagatatcacaacatcaataatcaaaaacatctgtgctgccgagattaccttgtacatgacacattggtattacgatcttcatttagattcgaaatatatcataacgcatgaagttgataaacaaattagttcgatagtaaatatctttgaaggtcaaaaaataattggtaactggaaaagaagcgaacaagttgttaaagagcaggctctaagagaagaagaaacaaaaaggaagggaaaggggggcttctgtttcttgaaccgaagtcaccattctttgccctagaaaaaaagatacacgtggaggggatctggcctcaagtaagtgctcgccgccagctgagaccacgaggtccctgaacctttctatgcactaacggtgaagtccaggtacccctggccggaaaagccttccagggtaaccatctggaagactggggagccaggggtgagacccaattccttccagcgctggaaatgggcgctcacgtcgacggtgccagtagagcggtgggagcgacgcaccgaccagtgctggtcgaagttggtgacaccgtagatctccggaacatttctataggggagattatagacatcgtagacgccgccatcactatcaacctggccgaggatgttcccgttgcctggggttccacttccatgcgactccacaatataccactcggtgacggggtttgtggtccagccataaatggccaaagtccagtccccttcggcggtgaaataaccgtcccaggtcaaggagctgagccggaaaattgtcagccttcttgggctctggccggtgaagggctacttaccgtgggttgccgcccttgaagccctttccagcgaggaattccgcctcagcactccagccaagttcgaactggccggtcgtggggtattcggtgtatccaacatcggccccgttgtcattgtatactgagtagtagaatccggcgctgtcaactccgtcttggctggtatgcaggatagtgctccgcttagcaaggtccgaaacgctgtcgttctcagtctgattgccgatcacctctctaatccattgtagacgttcgggtgaaagagctccacgcggtggtggggggatggcggaacttgccgcaagcatgcacgcaaaagctgacaggattggcacggccaggcgtgcttggccaaggaaagacaccatgatgatgataagaaagaatatatccaagtagaagggtacaactgtgacttgaaagttgagggtgttgagatagcaacggttgtttgccagacactcacctttatatgcttcgtctgtcgacgaaaaggggaaggatgtgcaaagacccgatctttcaacctgtatattcctcaggcagtttatccctttaggctacaattttagcactatgaaacaacctaagcgacattaaggggtcggaggaatcccgctgtctatctacctggctaatttctttcacctgcgcgtaacataactacatgtgattaatattgatttagcccccaggccacctatttcgtaggaaatgcctcaaacgccacatggaaactcacaaactattgatatacatgctaggagtttgtaatcttgactgcctgaatatcactttaaccgtcgcttcgaacagcctttggtgttgagattgattaaatcacctgcttatctggtacgtatatggccaatagtattcgtactcactgcattggtagggtgcccgatggcaaagccgatggtcctgagtgggctcgatggtcccaagatcgtgacccttgcgggtacgccccttgttctatatgatcattcaaaccggtttcttgcttcttgcttcatccttgtttattagcagggcttattttatctaagcgcacctttcatcgattgagtaattctgtgcggttcgaggccagctccgcccatataaccagtagctaatactggctcgagtgatgtaccggtgatactgcggattaagatgaagatgatttgaatttcaagttgcgactacgaatggctgagttttgatacataggttattatcattacacatgtgtcgaaatacattccacgccctcacctgccatcactattgctcactgcggaattatactccgtaacctaatcggtaagcagtgcgaccattcatggctgctcagtttacggctaacgacttaaccgagaaatagcaccatcccacgggaatatgtctcttttggtctagtaagttgatagcagtccgtgagttaaggtaatgaggtgggtcaatttgacccacttgtgtgaaaacccttgaagcagttccaaaaactcctcagaaatatccgaacctacgggaatgcggaagtaggattaaacggggctcgaaatattcttcagcccatatcgaagtgtgtgctctattaatatggatggtagcaagtaaaggctagattagtacgaaaggcttccatgtgaaaaacgaccttgtggcaccctacgtcgcagagagaattattccatggtagcctaaacttttgtctagataccctggcctctatcctaatttctaaattagccgccaacgattatacactttccgaactctgaacagggtttacgttatatctcagcccatcacgagtagataagctcattctaacccctttctgccagagaagcgcatagagaatagaaaggaaagaaaacagactatgagataggttcgaccaggaagagaacaatgtacctatgttcagagcatggactgtcaactcacagcacaagggtgctaagggttggagacggtagacttgttcaaacaattaccgaagcttacgacgcacgatatagtgagatacttatcatacacacgacctagtacttctgcaggaattggacccgttctcttgtgaaccattactatcacgaattagcacccacttattggctggagcagacttggcaggcatcctgcggaggacatccagggcttgatttttcgagctcaccaggtgaacgacagacgattctaggcaatcggtgtgtttcaagtcgtaatggccctaccaggccaccaaatttagaactgcctaagattcctggtggaacagctaacaaaaaggccaatcacatgagaagaacgtgatgcttggtaacaacgtttccgatgtgtcatcggcgaccatacattgccctggatctgagtggccactgactccactttccaaccgggaactttcgtcccgcggctttttagtaccgcggcttcattagccctgcagcttactatgccacagatagcaattgagaatgacagcagcgccatgggtggctctcacatttatagctaaattgtaggttgcagtacagctgagagaccagttcagaatggtcaacgccacttagcagcacaacatgacttcgtctgagcgccccttcgagagatattggaagaacaggttcaaggcagcgtaagtccaagagacttggtccaagagttttctggacgctttgcgccgagagaaaggctggatcatgttgtcccacttgtaagggttcagggtctcgaacaggcggaacggattccgcacctttggcttgtacagccaacgggtgtttgacgggcgataagtaccgagccaagtcccatatcagtgtcaccgaggcgcgcactgcaccattagcaaacactggcggtttcaagcaaagcaaaagtggaatcaatctgtaccgctatgtactgatcttcttctcatcgcaaggatccgtcgatatgattggacggctgggctcatggccgtttactttcaatttatgtcgccaactgctcgcaaatatggcgtcacctagaccgggagatacagctgctacgcgccgactgggtggtgattggtgaacacggagtgtcaatgacggattcgtcgagaatgtctacgtgagtgtgaagctgtccgacggcaagactcatgaacagaagacatttgcccttacagagagctcttaagcatactatgagttcaaaaatgtattggactgtagcatgccagggagactgcatttccagcagggtataaccaaaattcagccaggtatatggacgtgtactggaccttgtctagggaaatggtgagacagattgtttcggacaagcccgctacggcgctgcgctaggaactgaaggactatgacaacaggagttcaagctgtggacattcgaagacagaactaagccgcgccgtgcttggcacatccatatataaccctcatttatcctcttcagctgggagagaaactgtacaagatatcgttccttactttaacttctctttctcgagctggattcaatctgaccaggcgtcaggctctcgtcactctttccacttcaattcattgaattttcattctctctctttattttctaacttcctctccatcgtcggtcaaagacaatgaagtatctccctctcgtcgttgcagccactgccagcctggcacctacggcttccgcccattatatcttcagcaagctcgtgctgaacggagaggcttctgcggattggcagtacattcgtgagactactcgcagtgtagtctacgagccgaccaagtacaccagcacctttgacaatctgacacccaatgataacgacttccgctgtaacctgggctcgttcagcaatgctgccaagactgaggtcgctgaggtcgccgcgggcgatactatcgggatgaagctcttctacgacaccagtattgcgcatcctggtccgggtcaagtttgtatgagtcaccccctcaccccctgtcatggtaactcatcttctaatcatcctactctcccgaaccgcagatatgtccaaggcacccaccggcaatgtccaggaatacgaaggcgacggggaatggttcaaaatctgggaaaagactctttgcaacgagaatgccgacttgaccaaggacgcctggtgcacctggggcatgtctcaattcgagttccaaatccctgctgagaccccggcgggcgagtacctggtgcgcgccgagcatgtgggcttgcacggcgctcaggccaacgaggctgaattcttctacaggtgagacaaccgctcccagatttatgatattcaaggagcaacagtattgataccaagattctagctgtgcgcaagtcaaggtcacaggctcgggaactggatctccgagtctgacgtacaaaatccctggtctctacaacgacaacatgaccctgttcaacggcctcaatctgtgggtcgactcagccgagaagatagagacggatatcctggagacgccaattggtgatgatgtgtggagtggacatggctcggaaagctcgtctgctgcctccccttcggtcagcagtgcatctgtcgcaagcccgggtacaactaccgctgttgcgcacgcccatgttcagacccctgccagcagcagcacttcttcgacggccgctagctcgggcaatcttgtttcgcactggggtcaatgcggaggcctcaattatgccggcccaaccgagtgtgagtcgccttgcacctgtgtggagcagaacccttggtaccatcaatgcgtgacttcgtcttgagaggtccactcgctcattcgtggagacctgctgggagatgagtgtgagtggagaggagatatttctgggcttaaagggcgtagaattttgtctttctatgtcaagagctgccgccccgagggcccgataatacctccgatgtcaagcagctcacttatctgtcctgaagcctacaacgaggtaccacagcgaagctcgttcctgtacaattcgttacatttgtcaatctttttattctttggttcttcattgtatgaaggtcttcagaaacgctgtgttgatttcttcggatgcttcctgatcctcaatttcttgttgaagacctaggtcgcagctgatgtcttgtttccactgagacagttatgttaaagcattccaagaatctgtatcagtcatcttctttcatgcctgctcaatggttgtgattatatctatcttatttatatttctcttccctcgtagataacatagaaaaaagctcttttagctctagaaattgtttcaagtctctaatactctagattctgcaagccaagtgaatttgaaacactccgataaaccaagatatggactccttttagtcacacttttcacgtcttcactcggtatcaatattcaccgcatatttactcttcttgcggatcattggcccatagaaataaagcagataaggcaccaacgccataactgcactgatggaccccagaatagtcagggtatactgcacgccgagagcctcgtaaatggggccacccgcaacagttacacctcccgccaccacatatcgcgtgaacacgagaaatcctaatgcagaggccgaatatgtatcgtaagaatcaatgagatacatgtatgcaacaatgaagatggtggttataccgtagccgaaaaggactgacgcgatgagaggggaccagattgagatttttggctgttgaaagaggaaatatatcttagcgcctgcaaaacctgtgagggtatccgtatagacttacattgcttgtccaacccatccagaacagactgatcggcactgccactgcaccaccaagcatggtataccagagtctcatctcaggagcaatagtgaacttatctctagcataggccttcgcagtccagctgtaaactaccggcaccacgccgctaaccagcaaagtcccaacaagcatcccagcccagcaaaggttggtcagtccttcggagaggccatatgtgtcgccaaagatgtaggcatacccctcgagaaaagtgaagaggacgatataaataatggtcagatatagcgacatcaagatgatgattagctccgaatagaacatcgcaaatggccgatacacagagatcttcaagcgctggcccaggcccttctgactgatctccatgggagccctatatctctcatcaccagtctcttttcgaaggatggaagccttccagtagagaactaggttgccatatgtctcgggttgaaatagcaggaccagagccataactaccccacccatgataagcattatccactcaagccagcgccagcctagcgtgactggaatgtagcttcccattatttggccgatcatgggcccgataaatgcaggtatagcgtaagctggaaaagcataggtcttttccagagggttccataagtcggcaaccgtaccaccggcgcaggttagcggagtggaagcgaagaggccggcaaagaaacggaagataaggtgactgtggaggtttggggctagtcctgatgccatgacgaagactaagaagaggagcattgttgttgaatatatggcattacgcccgaaggtttctgagaaagggcccgagagaagggaaccaaatgcaaatccgataaggaacagacctattcagagacatgaggagttcagctctttgctataatagattccagagagaagacgccatacctgtcgctagagacccaacaacttccgatacgtggaagtattggctatactccttgactccacaagcatcgatcgccgatgcagcagttacggccactgcaatcaatgagaccaagaaggtcatgaagagcttccgcgatgtactctgatttgcggggttcaaaggatcatcttgtccgtcccagtccacaagaatcgcagcgtcaggggccatcgattcggtaggtcttttctcctgggtactgcaatagccgctcagtttgcagctacatggtgttctgttagacagttgcaagcctaattacattttctccaagacttacttggggccatgatgagcgccgatagggtagctcggacagctgcaattatctttcagctctgccaagtgctgttgcacggatttccgaatccgttggtactggagatatgcctccattgctggtagctcctgcgtgacagaagggacagaagattatgggcttctaagatggtgaggaatccccaaagaaaataacgacaccaacattttatagtcataacacctccgatccgctcgcctctatctccgatcaatcggacttgagtggattaacttcatgcaacccatcacaacaaaacggtcgaaagtgttcataagcatccggttcagcgacatacatagatctgttccgtacaccaacgctgagagatttctcactcttcggctttcttcgccagagacccatacatatagtcagctatatggcattgttagtattctccggtattggtaattttacacaatcatgtgacctggactaaatggacaatatgaagccatgaactggtcaatatgcgctccattaagccttacggatatatccaagcttacacaatcctttaacatgggcggaatggaagagttgatctgatctgttcggttctaaggggaaggtagccgcatataagttcatctctcccgtgaaatatcgggaacttctttcgccgatcttctccgccatcgggcgtacatcgggatccgatcttctttgtggcaatgattgatgattcaatgaatgccatctccgaccaagaatttccgtctcggatttttatcctaaaagttaactaagcctcttgtttatcctcgttccttacacagaaaatgttaggcaataacttggcccacaacggtgccatccagcaagtccccggatttcttcggcgaaagcgcaaagctgtcaattgcgaggaatgccgacgctctaagttgcgatgcgatcgccaaaacccttgtggtgcgtgcaagcgtcgcaagcgcgagtataattgctcctacgaagccctgtctggcccatctgtatcaaggaaaactcacaggcagcctgtaactacttcggcgtcacctgccttaaatggtggggcaggatctccgtctacgcctagacgaaaaggtgttttctcttcaaatctacgacccgaacagcctacatcaggattagagaaatcatctccgggtgtacactgggaaactgtgcttgaacggcctgttcccgaggaggatgttaatgacacgctatcacccctctcaatcggccctcgcatctctctccaggaaatgattgactcgcttccgccgaagtcttgttgcgactatctggtctcacacttctttaaacatatatccgccctgtttcccattctgcatggcccaacttttcagaaacagtatacagcgttcatgcaacggcctcatgacgtcgacttaccttggctggctttgcttttcgcgttatgttctttgtctctgaacactctagatgaaagtgaccccaggctagcgtgcgtctggtctcaactaccttcgaatgttacccaaggtgcaagtacggttcctgtcacggtttctgtgtctcgccgcctgctccggactgcaataacctgtctcctgcagggtgacttcttgatccggcacactttcagcacgttcgaagctctattaatggtaatatacagcctttctcacaatgagtccgtcgatcaaggctgggccctgttaggaatggcgctaaatattggcattgccttgcgttgcaatgtggagcagaaaaacatgggcccaattgagaccgaaagacggcgacgttgttgggctggcctcttgacattgcacacgtatcagggaatgctattccgggactttgatatgtcataccttctcggcattgaagctcctctacctgctgatgttaacgatgtcgatatcaccagcgaaggcattgtgcagcagtctcgtagcgagcccacacagatgtctgtcatgatggctaagcttcggctgttccggctttccacccagatctgtcgccatacctcgggcccttcacgtctcgaccaacaggccctgcgtaacttcgatgctgcgatagcggacgagcaaaaacagtgggacgcggcctatatggttgatggttctccaaacattctggactctaatcgctacgcatattggtgcgtcttgcaaacgtacgcgcatcatctctacctcctgctacaccgaccgtttcaccattccaaggcgccttattttcttccaatgtccagagaaagatgtataagttccagcacagctttgatttcccttcacagacaactttacgaagctcctatcctccgagattatttctggctgctcagtggggtgacaagtctgaaagcattacatgcggccgtggccctgaattcgtgtctccaagatgataccgaacataacttggactcttttcgaggggagatcgaaagtctgattgcccgcatggcagatctctcaagccgaagtcatatctgtctccgagcgtatcgaatactccgccatttacagtaagctacccagataaattctcaaattagccaactaaatcagtgatctatagagcccaagcagggacgggcgatgcccagacagggagctcggagaccccgttcgaaaatttattcgaagatttgacggatatccgggagtggatggatgcagatctggtcgattgggtatgttacctccctctagatactgagccttttgctaatgatcagaatctggacggacaattcaacgtctttgcgccataattaattgtgggcatgacgatattgtgggactgggctattccgcatcgggtcacttccgagacaaagagtactcgatacctgcccaagaaatctccagcagcgactcgagtacgtttgagcaccatatacccaattttccagaatattttgtggtctatcagatcagaggttaaaataaagcctagtagtttatctagcaaaccgtgcatgtagcttcccacttccaggaagatgtcaatagtagcgcttcccgctgagcatacaccagaccgtgagaggtaccttctttgtcctcgagattcccttcaggaagttccatagcagaaacccactgtatgtatactgagacttttgccttccatgttatggacacgagaaacgcggagatggcagatcatatctgctctcatgccctgggcggccctttgcaccactcgttttatccaagaataaagttggttggactgaagtaacgggcttttcaggattggattcactcttcaaacccctcaaactggctcagactactcgtataataaataatctgctactgtatcgatcttggttcgtattacccccggcgcaggatctgaagaaccagatcaccggttgcccgatcacatacatcgccatattacgtgttcgtttgacatgatgaaaaccaaggcgcggtgctctttaagatttgcttctttcgtgtagctctcttgtttcgtgatgctcgtgtgcgtgcgtctattggccatcgtatgaggtcttctggttctccaaagcggcataaccaagcgattagagtatccgtggcttcgtggcaggatgcagcagctcattaagcgtaccttggcgcatacgcatgcaacgatttgagtagagaagtgggatgtttgtgtgtggtcgaaaatgcatcccacggttagcttgattgcgtgctcgggactaaaaattcgccatggcagtggagggactcggccacttcccggccacgtcgcccctcccaggatgaacctggtcaatggcgccgaagaccatgatattggcgtcatgtagcataatacagttctatatgaaattgtatttgatggtgatatcagaatcctcgttcaatagaggtagctccacatgtgaacacacggttgagcttaactcttccctgacgcggcccctcaactaccaccatatcatgcttaaaacaagttgtttcagccttatggagcaagttactccacttaatccagtcatgtcctatggtaaagacctagagtagatctttaccaggcagcagaaaagaaagtggacgtaactgccataccagacttatggtatgatcggattggcacgcaattaccttagttctgaccgtggagaacaatagcatgatggatgtctccgctttggtggaccctggcctagccctatcccgtccttttacgcagcaaaaaaaacacacggattgggccagcttgcagaaagcttgggtaattgtagcgtgtccattttaatttctctcttctgttcgtaataagatgatatcacggcagtaaaacttggttcacggactcggcgcccagagcatgtccatagtcgcgcttactgcgctacagcagcagtcccttagaaacactccaggacaaaaacttcctggcgaacacgaaagagctcacccaccgtcttacgagcgatcgtcattcagctccctttgaccaaggagaaggcaaacacttagtctcgtgtttcttaattccatctgtggttcggtcatatcgataaaggccaatgcgcgctcggcatgggcgtggaggtgcatctggccggcacatggcaagccccctgctgcattgccatttcgaagctaaaatcacgacatcgatcccctgtcctctgataaaatatcttacacttctcacgcgataagcttaatatttattattcccctccggatctcattttctgtcgatatatgccacaggcctgaaatctcagtctgctgacacagaaaatgaccacaaaggttggccatattctggcgaaggtgctcgggatcgatctggaatcgaacaccgacccgtaccgtcgtgatggctcagataatgctgggtattatgtcgagacagagccaacatccggtgaatggctgcgcgagctcgtcccatcccgtcgacagattggtcgctacttctacgacttgttcccttttcttcactggatcatgagctataacttgcagtggttcatcggtgatctgattgcaggtgagatatcttacgtcagtctgttgaagcgagagaggctgacatcttcaggtgttactgtcggggctgtggtcatcccacaaggcatggcatacgccatcctagccaagttgcctgccgaatatgggctgtattcatcattcatgggcgtgttaatatactggttctttgccacatcaaaggatatcaccatcggagtaggtactccatctttttgtcacgaccaaaagctaacccgttcagccggtggccgtcatgtccactttagttggtaccatcatcatcgaagtccaaaaggactaccctgacatctcagccccaacgatcgccggagctcttgccatcatctgcggtgcgatcacgacctttattggcctgttccgtctcggattcatcgtcgacttcattcctcttcctgcgattaccgccttcatgaccggatctgccatcaatgtgtgcgtgggacaagtcaagacggttttgggagaaacggccgatttttctacccgtggatcgacatacatggtcattatcaataccctaaaatatctgcccacctcgcagatggatgctgccatgggcttgacggcactggccatgctgtatgccatccgcgcggcatgcaattatggaactaggaaataccctcggaaggcgaagctcttctttttcttgaatacccttcgcacggtctttgtgattctgttctatacgatgattagcgctgcagtcaatctccatcgtcgcaacaatccggccttcaagatgctgggtaaagtcccttatgggtttcagcatgcgggccttcccaagatcaacgctgatatcatcaagacctttgcccatgagctgccggcagcagtaattgtcttggtgatcgagcatattgctatttcgaaatccttcggtcgcgtcaacaactataccatcaatccttcccaggagttcatcgctattggcatctctaacctcctcggacccttcctaggtggctacccagccactggttcgttctctcgcactgctatcaaagccaaatccggtgtacggacgccgctggccggcgtcatcaccgccatcgtcgttctgcttgccatttacgcccttcccgccctgttcttcttcattcccagttcatcactttctgctgttatcatccacgctgtcggtgacttgatcacgccacctaaagtgatctaccaattctggcgcgtgtcccctctcgacgccatcattagtctaatcggcatcatcgtcattatcttcacgagcatcgaagacggcatctactgcacaatctgtatctcggtcgcagtcctgctattccgcgttgccaaagcccgcggtcagttccttggccatgtccagatccactccgtcatcggcgatcaccttgtcgaagagaccggatcagccaaggaattcaacaccgcctctcagctttccagctccgattacaagcgcacatctagtcgaaccgtcttcctcccccttaaacacaccgatggttccaacccgaccatccctatcacccagcccgccccaggcgtcttcatctaccgcgtatctgaaggcttcaactaccccaacgctaaccactacaccgacaatctggtcgaacacatcttcgaatccacccgacgtaccaacccctccttatatgccacccccggcgaccgaccatggaacgaccccgcccctcgcaaaagcaaggccgaacacacagataactcgacagaactaccgttgctacgggcagtcatccttgatttctctgctgtcaacaacgttgacgtgacctcggtccagaacctgatcgatgtccggagccagctggaccggtacgccgctccggatcgagtccagtggcactttgctcatatcaacaaccggtggaccaagcgggctctcgccgctgcgggattcggtcggccgtcggatgtgcctgagctcaagccgatcttcaacatcacggagggagactaccctggagataactcggaccagcgtgccagtgatgtcgagtcgcaggtcggcgatcaattaaagcagaacaagacccgagatgataagagcgctgaggttctgagtgtacgggagatggacgaggcagccaaggggtcggagaggacagccgtgcaacgacgtggagagagcaagccggcagtggtttccggggtgaacctgccgttgttccatatcgacttgaagagtgccctggagtgtgtgacggcgtcggtgtctgataacccgggcaaggcgcatactagctgatatgattaatctgttggaattccatacataatttacgttagacaatattttagcttacttcatacatactttccccatatgtatagaacttatcccggtgttctagagtaactgtagggctaaccgaaatctccacatcgtctcagacgatcccaacccatcggcgactctctcggcgaaaccccgcatcttaaatcagactgtccgcggggtaaatagtcaacaatatctgccgccattcgtttgatatcccttctcttgacctaaccttccatatcacacagatcaaacagattaatagactacgaaccatgggctccatctccctcaccgacatgtccaacccctcgtgcctcctctacggcgcccacgacgcccgctacgaagaccgacccatccccaccatcacttccccaacagatgtaataatccgcattgcctacacaggcgtctgcggcagcgacgtacccctccctctttcccctatatctcccaattctaccaacccactcaaccccctaaccaaagaaaccaggtccacttctaccaccacggcggcatccaccgccccataaccccctccaacccgataacaatgggccatgaatccaccggcatcatccacgccatcggcccggccgtaaccaccctctccccaggcgaccccgtagccctcgaacccggttacgcatgccaccgctgtaatctttgcaaatccggacggtataatctgtgccgggagatgaagttcgccgcggtccctggcatatgtcacggcaccctcacgcggttcttcaagttacctgctgattactgctaccggattccggaggggacattaggattggatgaggcgacgctgttggagccgttgggggtggcggtgcggtctgtgagggaggtgggggtaaagcctgggatgagggtggtggtttttggggcggggactgtcggggtgttgtgtatggccgtggcgagggagtttggggcgagcagggttgttggggtggatttgagtgagaggaagttggagtttgcggaaagtgtggttgggaagagggtttgggggggtgggtttgttccatcaggagatgcggaggatggaaggaggttggtggagggattttgtgggagtgatgatgatgaggcagggttcgatgttgttattgaggctacgggggcagaggcttgtattaacttgggcatagaggtggtgaaggttggaggggcgtttatgcagacggggctggggaggaagaatgtgagttttcccattggaacggtggttgcgaaggaggttgtcgttaaggggtgttttcggtatgggccgggggattacaagctcgggatgcagatggctgtggaggggaggattccgctgaagaggtttattaccaaggtggtaggttttgaggatgccgttgaggcgtgggagactacggctaggggggaagggattaagacgttgatcagaggggtggatacgccggtggaagtgtagctgttcattggatagctagctatacctatatccttcacatgcatccgcactataccctctgtgtctgagtagtcatcctcttcacctcgtcctccaagacctccggcagcgtcgcctcaatactcggctgtgtcggtgtccatcccagcaccttggctcctctcctggcgcgtcccctcgaattcaatccccaacttaacgcctcatacccaccatacctcttcgcgtcctccagactaatcttctccttctcgacattagaaagcaagcctagctccgtcgccgtcaatgccgtcgccacagccaactcaccccaaacatgctccccgttctcagtgagataatacgccctctccccccacagctcaggatcatcccgtccatgcacagccgcctccacaagcaggacatacagctcactcaaatcatagatatggatattattccatatcgacttaccatctccgatgagtggcgccttcttaagctgcagtgtcaccttggccagctcgtagacttgtcgtccgcgcacggatacggggcctcgaccacgtcctatagaaccacgccttagcagtatcccacttagaagaaatgtctaaacataccataaatagtaggcgggcacaccaatgccgtcttcaccacatcccctttcgccttcgccgtctccaacaccacccgatccacatttcgatggaacgcatgctccggcaggttcaacaattcgtccactccatcccagtcatcatagaccttgtcgctaccctccccgaacacattccgatccgtgtcatggaacgtcaagatacctgtgccgccagtgtgaagccagtatccgggcttttctttgctgtggcctttttctaggcccttggcgatggcgttcgcggcgccttcgtggtcggaggcgtcggcggtgtctgctagttattaatatatgaaatatgtataacaggtaggtagggcttggcatacgcaaaacgatatcagcttcagcactctccttctccaaaagggcagagtcatctagatcgccgatgacaacccggatagaagggtactggacttggaccttttcggctttctctggagagcgcaccagcacggtgtatttatattcggggtgcttggcaaagatggcgtagagggcgtcgccgccgatgtagccggttgcgccggtgctgaaagtcaattgttagtggggtatatctggggtgagattggatggagtggtacatgaagatcttcgggagagtagtcattttgcttctgtagaagttcttgaagggctagattatggattgtgtctatttgtttatgggtaatagctccgttatatcacttctgagagttattgagattaataatggcttttggcgatgaagtcagtccgtaagccaatgacgtcggattcaccagttggtgattgataagtgctttccgcctgccgtattcggtatgctcggccgacggcgacttccgccgactgcaagtccggggttaccactttctcgactcagcttaaactccgcatgcagggttcgacggttaccctgttacccctcttgcaattgccggatggcggagaatcgggtgtatcgtgtgttgctgatgctcaaattatggagttgagtttgacagaattctgatgcagaggggtgtagtcctgctaggcagcagaatatcttgcgcgccatacagagatagtatattgaacttgaagatgaagccttgatgagaccatagctttcctgaaaagttatttccaccatgaacagaatgctcgtcgaacaacgagcaaatggagcgggtagaattttgagatcgatatgctttgataatcagctatgctaccactgtcatgaatatcataaaggcaccgtgaactgcgggtcaaagataagctccctggaccatggaaatcatcccaataaggtatgctccatatccacccatatcgctcatcaaaagacatcaaaaatttcttcaccggtggggtctcgcccgcaatggcatgatctcgacccgagcgttgctagggcactcttcacgcctgaagaagcttgggcgggttgagaatttggactaccaatggcatacatctcatatgccgctcctcccggttctaccgttcttatttgacagtcggaaagcttccaaggacaggacgcgctatcccctccatccaggtgggtctagcctttccccgtggcctggcgggtgaaatttcttccccacgtgcgactcgctttatgaggatggctgcgcacaatctcactgattaagaaagggccataaggctgtagaaatagtgctaaaccaaggctttactgccttggtacagttatatccacttcaagaggtgatcagtatggacaatatcaacttcttcagggcgtgactcacgatgcacgaccacccgcatatctccgcggcaagcttttacgtaccaatcaaagataagaaatgtgatgcagtctgcttgatggcttggctatcgggtcatgcccgcagtgcctttgcgtctacataaagcggggttctccgctgttggcttttcacttccccctctcttcccactgttcgcttgctctgaagaatccgcctggacagaatgggtgcagaccgtattgcagtggccaatgatggcatgactcgtgagagaaacatcgaggctcagagtgccttcgcttctactttggtggtggatgtcgagaaggcgcctcattctaaggaagtgcccactgacagaccgcataccaatgtctatggctccactattgacactcccacttctgtggctggaaccgatgccgtctatgcggctaaggcggcgcttctgaaccaggcgctgatggatatgggtatggggttgtatcagtggttgctttttattatcaccagtgtgggatggtttctcgatagtgtatgcctccatatgaacagtggaaaagtgaagaaacatttactgatcagtacagttctggttgatgtccttcacggtcatcgccccctccagcgccaatgaagcccagttcttcttcaccgacaacaaagaggcctacctcttcatcagtatgtacgtcggtctgaccacgggctccaccgcctggccctggatgtccgacatgctgggccggaagtggatcttcacgagcaccctggtccttatgggcatgggtggcctcgtcggtgctggaatgccgtctttcaccggcctttgtgtcgttggcttcgttgtcggctttgcagtggctggcaaccaggtcgtggatgcgatgattctgctcgaatctgttcccgcatctcaccagttccttgtctccatgcagggtgccatgtggggactgggtcagctggtagcagcagctgtcggatggtaagtctacctactgtcagacaccataccacgcaatctaacaaccacagggcatttatcgctgaatacacttgcggcaccggtcccgacgagatcagcaccggcacagccctctcccaccagtcccgcgccgaccactccagcagcagcagcagctcccaatgccattacgtctccaacaagggctggcgctacgtctggtggaccttcggctgtatgacactctttctgtacttgtgccggtttgccttcccgctgcgcgaaacccccaagtatctgctctccaagcgccgcgacgccgaagccacccagctcgtcaaggacatcgccgcctacagcaaccgtaagacctggctggaggagtcctcctttgcgcgcattgactcgaccgttgatgccagcgcccccgagtcccgtcgccagtcgcgcaccaagtccctcctgtcctctgccggagccatcggcctccccgttctctgtctcctctgggccgtcgccgggttgactttcaccctgcacaaaacctacatcagcaagtacctcgccactaagggtgtcgaggcggtatcagctacctccgtgactactggatacctctacagccggtacctgtacgttgcgctgtgcgctatccccggcccgatcgtggtgggtcttctcattgaggcgaagggactgggtcgcaagcgcacgggatctattgtcgctgtgctgaccggtttgttcatgtttctcgcgacggtgtcgcggtcgaggaatgcgctgctcgcgttcgaatgtatcctgtcgttcttgcagacggcgacgatggcggtgctagttacgtactccgtcgaggtgtttgcggcaccgttccggggtttcgggctgggagtcgtcggattctgctggggattgtttgggttgattgctagtattattacgacgttcgagagcactgttgccgatggtgcggcggtgtggttctgtggtgctatttgggtgatcatgggtggtgcttggatggttgtgcctgagacgaagggtcgggctgctgcttagatgggtgtgatgtgagggaatgatgtgatgcgatctgatgttgaatgagtgatgattcacgtgtgttgatgtcatggcaagattaattgcaagtaatgaacgaatctatatacgatgattgtatctacagatcccttctgtgcaccctctggtaaacaatagccgcaaccccaagcacagcagacacccccaacaaccacttcgcatacccactctctttcttctttgcctccttagcctcaactttgggcttccgaaccatataccacggcacaaaatcccccatatcctctccctctctcgcaagctcaaacccatgcttcaaatacacgggcctcgccccaggcgcagaaaccacgaatgtctcgataccttcttcatccgcgcgggttgttccccacttgatcatctgcgatgcgacgccccgtcgtcggtactcgggcttagtgccgagcatgttgagatctaaccagttagccatatccatatcccggaccacactcattaaaaatcaagaagtgaaggagaaaaaaaaggataaatcatacaataaaacctcctctcccccatgatagcccccacgttagtcttgaaatgctccagcgttaccttcaggagctccagatcgcccacgtgagatgggtacgtagcgaggagttcttgagtctcggggtcttctccatcggcatgctcctctttttcagtgtcgctcacggcaggatcttgctgtataggagcaggcagcttccactccagaaacccgaccagctcatggtctttctctgtatcgatgactttcaggatttggtatttatccaccccctccgtcagtttccgggtgaagctggctacccaccaggcgtggatctcgggggtgttgggccagagtcgctggtccacgggttggtcgaagcactggaggtagagggttgcgagggcgtgggtgtcggagggggtacaggggagttgttggagcattttgatcttgaatatcctttacttctatggggtttttctttggtagttatgtagaattagtttgggcgcaaaggacagaataggacactctggaggtgagaaaaagggaacggcggtgggatttaatagccagctgtgccgtcttacggagattacgattaatatgcaaacgctaagatagtcatttgcttgggctaatcgcgctagttactccgcaagatatgaatggttgggcagggaggtgagaatatagccggcacttggactagtgtgtagctaagatgcattagtggtgtctgttaggccgcccaccaatccgcgtaattccgcttggataatttatagtagtgttctgcttatcgtagacattaacattatcattaaaattctgatccataaatcaatatgtggtgatcccttcgtaatgtgtcctagtgagtcttctccaacatgacaggctccggactccgtaccggacttgacatccgtgggtcatgcgggtaagcctgtgtctgaccctggactggtgcctgtgggtattgttgtgggtacgcctgcggctgttgtccctggtggccgtagccgtagccgtaattgtgtccctctccctggggaggttgttgctgcgattgaccctgtctcggcagaaacgcccggcgattcagtccctctctcgcattcgatcgattttctccactctttgtagcttcaatctccctcttcacgccctcatacatatactcgatgaactggatctcatcctggatatccaacgaacaaccagccagacacagctcgcgctcgcgctgctcaatatactcgcgaatattccgccactcattctgatagtgtttcaatcgatccggaagccccgagcccttcaggtaagtcagcacgccggccatgatcgtgttgatggcgccaaaggccgtcacggcggaatgggggccactagcggcgccgagagccgttagggcggcggccacaacaatctggatgcccagacagacgttgatgaggatgctgaagaagcggtagcgcgtggcagcagatttttcggcctcgacgacgcgcgtgtagatgccgatattgggggcggtgcggctgaagtggtggagggtgttgagggcagggatgctgtcgatgccggtgagggcacggaagacaaggagcttgtcttggggtgggatgagggagctggcttgtgtcgtggagatggtgagagggggtttgtttgcgggtgggtggagtggtggcatgggaccgtgtgttgagatgttggatggaggagtgggagttggcatggtgctcgcgctgccgttcgggatggggatgtcatagggtgggttggtgtggtgagattgtccttgtgggattggaggcaggccttgttcttcgcggtcgaaggcggcgtggagaagccgtcgagcgaagttgggacggcgattagggacggccatgatgagttgaggagaaacgaggtgaaaatgacggagagaattgtgtgcgattcagttgctcgtaaagagggtccaacccctttatttgtagcggggtggtgcttgatccaagctccttttcctcatttccggcatggtgttggggggtttgataggttgctcagcacaccttgatgggcgccacaattgctgctaaggacggatatgccgcgcgctgagcgaatggatagcggagagaagctgaacgacaccctgcattggtccattattggggtgtcagaccgtcgagggttcagcgggcaaaactctgaagatagagagctggcgggctggaccctcgacccacagcgatcgacacagttcggcacgagacatgggacgtgcaccttggccagcagtgagatgagagaggtggaagttggaaccgattggcttgtcggcagtgggccgttcatggtggacatgcagtggacagctttggggggcagctgaacgggcctggcgttcctgagcattgaatgccagtggatgtgttggatcgaactagcagaaggatcgcaatgtgattcgccgtgccattgtgccgattgtgatgtgacaggcgacacgagtccggctgatgggggttgtccaagcaaacaaaccatcctgcagggaaaacaagctcagaattgtccgtccacccgttcgcagcgggtttacccgctgttgtgtctctttgtgttgtcggagagaaagtttggcgcccgatgaacccgtgttctgcatcccgtctggcatctccacagcttgactaactgactggtcgcaaaaacaggtcattaggatggcgggctgaagcgatgccggcggctgcccgaaccatggatgtgaggctgtcagatgcagcgcaatcttgggactgcagctatccagtgcgacgtctgcaagcgaaccgccgatcggtcatggctgtgcgggccgagactaatttcgtctggacttttggagtgagagtcagacgaacttccatgaagcgacagctattatctgcattatgtatagatctctgatgtgtgttacctcagcttcaatccggccgaggtgtggaaaagaaggatgatgataagatgaagtttttatctttcttatcgctttctcttattctgttctttctttaatctccgcttctcctccccgcgcttattaatccgtctgtaacccgactttcgctcattaataaaaagaagcgcaaaagagcccctcaatggcgccattgcttccattgatatccctcaatataatccccaattccaattcacagtccttctaaaccaatatatgccttctactgttaacatgggcgaagcacctcccgtcaaagagcatctgctcatcgcctacggccgcgatcttccgcaatggctgatcgacgagacgcaggccaaattccccgaagccgaactttccatcctgcagctgcccaatttcgcgccaattccagctggtcagtgctggcttctcgaatccctgctcgctctgtggccatcattaatcaatcaaattcaccagaaatcgcgcgcaagaccactctcctcgtcaccttcagcaacctccccgcgccggaagatgcatccaagtaattcctccccctgtcacctcaaatttcagctacagaaatagaacacagttaatataaattcatttaaatcaatctagaatcaaaatcatccactccctctcctccggcctcgaccacctcctctcccaccccatcgtcaaagaaacctccatccctctcacctccagctcgggcatccacgggcccccaatcgccgaatggaccatcatgaactggctcgtcgcctcgcgacgcttcgtctacacccacgaaaaccaacaaaaacacaactgggcgaaaaacgtcgacttcatgaacaccgtccatgaccaagtcggcaggaaagtcggaattctcggatacggaagtatcggacgacaaagtatttccttctccccttacaaattcccctgtatcctggtctccaagaaaaagcactaactatggaaaagttggccgcgtcgcctccgctctaggcatgcaagtgcatgcctacacagcctcgccgcgcccgaccccgtcctccaagaaagacaacggctacatcgtccccggcaccggcgaccgcgacggcaccatccctgtatcctggcaccatgggactgacaaggcctctatccacgaattcctatccctgggtctagatcaccttgtgattgcgttgccgctgacaccgcagacaacccgtatgcttgggactgaggaattcgagatcctgagtcgtggtgtgtctgcagaacggccacgtccgtaccttacgaatatctctcgggggaaggtcctcaatcaggatgcattgattgaggcgctgaaaggaggagtgctgggcggagcggcgctggatgtggcggatccggaaccgttgccggaggatagcccgttgtgggaggtgccgaatgtgcagatcagtccgcatgtcagttcggcggggagggaatatattccgcggtcgttggatattatgagggagaatgtggggaggttggagaggggggaggaattgttgaatgggtttaagagagggaaggggtattgacctcattgcttatggggttgggtgacttcatgtatatgacttttggtattattcattcataaatagttcatacatatacctaactaactgagagaattaatttattgagtaagccatccccgaataccctcctctacgaccacacccagcacacccgcgccaagcaccacccaggtccaggggttcactacctccgtgagaccgggccagaagctgttcttctcgcgccgccagctttgcagctgctcgtacttgtgcaggtcctcggtgcggtaccgcgtctcctggctggcttcggtctggcggtcgccgccgacgaagcggaggaagaagtagttggttaggggaccgagaaggacgatcgggttgaagttgttggcgacgttgaggacggcgaaggagatgtgcacgagggtgtcgccgaggtagctggtttcattagcccagatcctgcaggtagtatgaaagtgaggatgcgaaggggcagcttacttagggtgtctgacgatactccacacgccgtgcttgcacagatcggtccgttcctgacggtgcaactccagctgcgcatcggccatgacttccaatgcgaatccagcaccgaagagcgcgacaccaagtgcgcgcacggcagactggacatcaccgtccagcgacaatgtcgacgaagtcaaccggaacggcacggtaaagggcagggcgatcagggtgaggaaagccgcctcagggagatactgcttcaagagagccgaggtccagaatccattggggtcttccttcttcagctggtcgtagcgcgggtcatccttgccgcgggtgatagtccgtgaagcgatgcgagtaaacagccgagtaccccagaccgtaacacaagtcaatagtaccttttcagtccaagagagagtcgaccaggcagtttgcggggagatgttgtgatagtagacttggtgaccaatggcgctccaccaggcgttgatgacttggctagaaggccagcaccagtctttaatttcggcgcggtcagtggccttggatgcaataaaagcagcgatgtcgagagtcgtgtggagagtgaaggaggggaggatggtcgatttgaagatcccgatgtcggccgtgtgaagccgcgggtgagggtgaagatgagggtgcgggatatagtcgttcccgaagggagcgctcccggatacgttcatggtgactgggatgatcactcagctgtggttgaggttgaaagagatcgagcttctgggaggaattggatttggttttatagaagggggtgccagttgatgtcagtcttatgtaacggcgtcatgacgatgacgtccgctgcttgcgggctggtggagccgccctgccagggccagactgggaccctgatcggtcctgccgaggtttaggttcgtgttcaagttgtgcggggatgcaattgattgacattggtgtttgctaccttgtactgtgtaaataacattctgtatcttggtagactaatctggtgcaaagcagtaggccactcgaacagctagctggctctgataagataagataagataacaagtgaaatcacttggaatgcccgcgctgcgctaaacgagagaaattcaagtgcacatccggcaatcccgaccgttctgaagtccggtaattgcgctgtatcaaactcgtcagttgattcctccagagatcaagcattgtttctgtatctttatgtggcgggttaaatgcttcacactggtctccgcatccggtataaagatctgtcttggttaaatggtcgcatgtggttgaaatgagcgaaatgtcggcctcttgggtcagagccagactgtacaactcacacccatttggaatgttttctaatggcagcttctctgtgttaatccttctggtctttgatatgccatcttcgttctgatcttgcaccttgtaacgcattaaatacgaccgtgggtcatgtggacccagcacaggcttcgtcggctcgtcccgatcagcatctgggtgcttctggagtgcggctttggcagctagataccgacttagatggggtgagctcgggtttcgctggcttttgagttgttcccggcgcttaaggatagcctccctcttgcggttctcaaagtcgagtgcacgtcccagctcttggtggttattctcagaaagaagctgacgtagagtagccgaggaccttccacggtcgggtgcgtggctttcccgaagttcggagtctgcagcgctcccaagcaagggagtaccagctccttcatgctccgtttctgcttctgcagagctagcctgaaatttgggagactgattatgagtagtaacaacaccatcctctgtcgatcctgggtcgcctgatgacctctctggtgaaccgaatctttcttgcgccaactgctgcaatgagcgctcgtccccatttcctgtgggcacctcgcctgtggttgactgagacaaggaggctggagttttccccaaccagccatcaagggctccgtttccgggatgtctgtcatggtccatcgaggtttgccttgtcctcggaagaggagttcgaggcgtccatggactagacggcgaagactgagcttcagtcacgtagccagcagcagtcgtggagccagcagcagtcgtggagctgatagagggactcggtaggagagaccctggagagcatgtctgcagtgtttcctgtgagtttcttcggctttcagtcggataccgcacaatttcatgtctcactatcttgtcagtgtcactgcgcgatgaggaactgtcgcgcgtcggcatctgcttgcttggctgagatattgaccaggggttgctaatcgcgattctcgtctccggacgattctcagtattgaagctgtctggatcctctacatccggagtccgtggtgtcgaggaagagccataactgcttctagcccttgattcatccggacttttacgggcaagaagcaattcgaatgagtttcgataggaagcgggctctttccctttatcgatatttctcggtctctctgttgattttgcttgaacgccgtacacatcacacaaaagctcttctaccaaagaaagaagctcttcccgatcttcaagaagaacatcatctttagcgggctcaatgttgacgtcgtagcttgcattagtacactggaggtgaaggcacagaagcggatctgtaatgtttatagctgcctccttactggaagcaacgacgcggatataagacttatatagtttcgcaatatcttgcgcgatccctcgggtggtcgataagggcctgccatcaatactgatatactgccccaagccgttcagtttcgtaaggtctgacactgtcagtcgcactcagggtctcacagagcagctacataccggattctggctttggaaggaacgcgagtatccgaaatggcctgtcgctgtcattctcagatggccagaccttgaccagacagctagaggcgacttcggtgcccacaactttcaatactgcatctacaaggctagtgttgttgcctggggcatacatccagttgttcgtctctgtctttgctttgaggaccttcaaggataaacgtttggagggttgggcaatagcgtatgcttgtacgagcttcttgatcctcacgaccgtcttggccgctttctttaacgtagtttgtctccggactgggatgtgtttgaacaaatccgctatgcgaacactggttcctaccggatgtgacgctcgctgggtactacatcggtcagctttggttatctcaattggcggtaggaatcaccttagaagctctccatttctgctgtatctgatagaagaaccaaccggctcatgctgtaatctagtggtgatagtcacgccacgggatacctcagccgcactagcaagtgcttcgcctctaaaacctagagactttccgccgatagttctaagatcttcgacggattgaattttgctagtgaaggtgcgtttgcagacaaaaggatgatcggtagaggggataccatggccattgtctttcacttgtattacatcaagtgtattttgtgagatctcaataagtaccgaagtcgctgcggcatccaaggcgttgtccaggagctccttgacaatggagcaaggatcggaaataacagacgcggagccaattgcccgcaccgccgctagggggagcgctgcgattggcatccttaactgaatacaagcgattggtcagtcattggagtgaccttgacgtagaataccgatgaaccatatcaaaatatatattatacagctgactttagatggagtatacgatgcaatagactgtcctggatgatcaatgcggatgaaggatgatgggtgaaggagtatttccacgcacaacacggcggctgagcacgtgagctgagtcagccgcaccacgtggcttgtcaacatcgacaacattcagtctccctctcgatcattcatcgcgtgctgccagtggatggattcagagatgatgtgcaaccagcatggctagctcttcattccggctgtcgcaactggcgattccatcagtttgcatcttaattagcttcctcgcatacagctcgcagtacttcttcctgtacttcgagccagctccactgagagacactgaattatggcgccttaacatctttgccctgtgcatctggatatgctattatcgaacctgcactgtagatcctggtcatattcccaaagattggaaaccattagacagtaagcaactggaagccgaccgtgctagtggtcgtcaacgatggtgccgtaaatgtgaggcatacaagccgccaagagcccaccattgccggacgtgccaaaggttagttatgtcaattcaataggtgggcttcatactgatgctggctctagatgcatccccaaaatggaccatcactgcccatggacctcgaactgtgtctcgcacttcacgttccctcatttcgtgcgttttctattttacgccgtaacgggaatgtcttatcttgagactcttctctatgagagagcatcaatcatttgggcctcccgaaatcgtccaagcgtaagattattactctagacgagtccacagaagctgatgcagatgttgcttagtatttagggcctagtgcgctgcagatgggccatctattcgttctccttgtggtgaacagcttcacggtcttctttctcatgattcttctcggtcgaaccatctggtctatgagcatcaatacaactactattgaagaatgggaaattgagagacaccaaacactggttcgtcgatcccgccacttcggtgggtatttgaccgggccaggtggcgtcaggattcggatcagaaaacaagaattcccatacgatatcgggatctggtccaatatcaaggcggggatgggtggaactgcaaatgttggtttgactttccaatcacgttctgactgagctgcgggctaatctattgtataggttcttagctggttttggccgttagccaggacacctgaccgtcggacgggattagagttcgaagtgaatgacttcgaaggtatgtggatgagactcaatattagatgacgggctgacctcggatagatcctgatgttacctggccaccccccgacccagataggatcccggttacagctagagcagctatggacgatattgagccccggactccatccatctacgggagtgcagggggaatgcccattgggggcccgaatgctactctgagagctagccaggacatcagacgtcgtaagcgcttccatgatcgggcacaggaagaactaaatcaaagcgcgtcatctcgggaatcttcgccaggttacagttctgagcccgaagatggtgaggaaggctggaagaactctgaaggcgagagacttcgtgactttggagtggaagaggacattgagttttacgacgaagaggacatcccactggccattttgatgcaacagaaagcacagcgacaatgagcatactcccactctcgactacaagatttataccgtacatacataccgatgccagcaatagttagaatttccaaacatcagcctataaaaatcatactctggcattctgtttctttctcaatccagcttgcagtatccacttaagccaggctcaggtggttactgccacaaaggaaacccaaaatccacagtatcagcagccaacaatgtccctagtccagctgtagtgtttgattatgcgttcctcctcagtcagtttggaagtaaatggggttcttgctatactcggccagcttctcccgtacccaggcagcctgtctctcaccactgtcagcaggaagactgttcacaatgccggttgtgtcgcctccaccaagcagcactgagaacattccccgcaaagggagatcatgatagcctgggaccgttaggtcaaatggctgggagcgctggaatagctcttccacggatttagcgttgtaaaattgtgcatccaacttcaacgccaagatactcttgtgaatattgcggtagccggagccaacactgggatcgcccaggaagtagctacctcccgtgccccaatgttgcgctgtcggaaaatcctccttgacatcatcctcaacgatgggcgtgcgggctgctgagatctgccagggcatcaccggggcatgcagttccatgctgagcgcttcacagaaatcgaggtatcggctccattcgcgtggggcaaagcaaaagtgcaagggatagcttgctgatgtgaggtcgtcacgttcccaccggtcgacggctaagaagtcgacagggggaagctcatcatcatccttctccgggactgttttgggccataccccaatagcatccaaatagtctgctgtctttttggcttcttcagatgccacgttctcctctttgtatatccacaacgcgctgattttttctcccgcccagaggttaacctgccacccaagcgaaacggaaggtttcccagtttgtgggtccttcgtcatggtccgcaccagccagtgcagtgcacgcacatatccacgaatggtgttgtcgatgtcttctggaataagatcgatcatgtgttcttcattccggaactttaaagcttcttttagtgaatcgagaaatcgcacttcggagtccgccgtgtagccgcgcttctggcactcgccaataagatcggggttgaagatccacgcggcgcgtagagggcgtggggcctccttaaagtccatgagaagctgtagcgcctgaatgaggtttccaaggctgtgtttgtgcttctcagcgttaagtagaacatcctccccaccggagaagttgcaggtatatgatatcagcactggcagaacagtatggtcagtaccaatagctttttcgatgtcacgcgcaaattctatgacttttggtgtacattcttcctcctttaagatatcatcatcggggtcgccgttaccacgtgagccggcatatttgaagattgacgacgcgccagcctgcacaaaatctgtgaagtcgtcattactctcgtcgaacgctgaaggtctactgaggtcccgggtgcaaccaccgaaacttaggaaattagggaatccagggacattgagattcacagcaacattgatactcaaatccagcactgtgttaccatcttcgctgacagtgagagtggggtcagatgtaacttggtacaggactccgtctgcaatgaaccgatgtgcctgcacttcgtagtccccgggccccaccagcactgggaattggggagcttcgtcctgcatatccactctgtttgtgtaaataaagcgggacgtcttttccatgaggtgcactgtcaatgctcctgcgcttattgagtcttgcttcttcagcttgatgggaagcttgacagcacccggtacttgactctcatgctgcttcacatcgtcagccgtgaagctgatgggtgtattgcgtgataaatcaatatcctttcgagtgaagtcatattggatgttgttcacaataattggatctacgctgattgttgcatctcctgttggcgggaggacgcgacgcggtttcgtggttgctgggactaggctccagaagtcgtagagcgggttttctgcgttgctgaacgtgacatgcacttcctctccctcgagcccagagatgttgtcaatcacaacgtctgtcgagctgtaatgttggacggcgtacgtcacattgatagtcggggctgtctttccctcttcaacctccacttgggctggctgaacctttgcaatggcaacgatggtttcatcatccgtgaataactccgaggcggtgatttcgtatgtgccccggttcaaatcgacttcagtcgtcacaccgaatggcacgtctttcataaatactccatcgtcgttttcaaagaacagcgcctggctgtccacggtgatcccatctggtcgaggatcacaagcgattgggacagtgccgcttacgtcaggcagatagtttttccatagacgtacggaattcttgtagtgctcatctgtaggatcaccggccatagaaaagtgaaagtccacgactctgaagccgtcggagcggtcagacgaactaggctgaaaggtgaacttgacgtggacttccaaatcgtcgccgctaggatgactgctcttctcaaagctgaaggcgcaccaaggatcggtcgagatcctggtgtcatctgagagtttagcgggcgacaagaatgcaactccaaggtaatctgttcctttaatttccacggcattcccgttcttgtcgtgtacgtccgtgatagatatattgccccaattcgcatcaccatctgtgttgaccgtgccgtaaatctcctctcctgagtccgatgcttgggatcgacgaaaatacttcatgatggcggtcatgatggcggtatgtagtgtcttggacgttgagtcttccgttacagagagtaaagtgtgtaagtcaatcgatgtctgctagtaggtttaagtagtagaacttcgaaaaaattggcaggtgtgagagcggtctatttatacagctatccctccctctcgactatggtaccggcccagtctatccacgatagacattgcccaagtttacgatcttttcgcatatggctagctgtagttgtatggtatgcgcgatttgtaggcagaagagacgtcatgaagaatagtggtccgtcggagacagcgagacataagccttgcagtttgttacagtcgcagtagcattacatatatcgaggggctcaaggagtgtgatcccgtcttcttattggctttccattactactgtgaccatctatgatgacttaaacgatgaattcatgctgctttcatatcaaagctgccacaaggtttgtacaatactctgcatttggagatattcccgtatacataccgtggctaaaaaccccgtccacccggatgcaagcccagcatgatgcacttcgggtcttgatgaaacctctctggcaagtagcctgagctgttcgtacctaagactagatctcttgtctgtggtacgtaagccttcttcacgagaataatcaaatgttccatggtttaagggcaaacacttggagacttgacgatccaaaaagccgacccttgcatcttgtgtaccccggggacgggcatgctgcctacatgctcagctcctctagtgcggtagggctcagtttccccatgcagctgcgtacgcttgtgttacattagccatcaaggggttggccggacttccccgcgtctcagctggcatgtcgagcgcaagcggaggatccgattacgatatagctcagttattggatcgtcagttgacattgcatgtatttacataggataagcctttgaatactagtacccttactttgttttgaataactcacttcttacgctgtgtgttacagcattggacgcatggggatagcggggtgggtatttcacatagcccttcattttctccatgagttgcatgaatgcagtagaatttaagggtttttcatagtagcgttgacagctcagctgaacctcgattacactgtactacaggttttctgcagtagtcgtatgttctaacatgaatatcagctcaagcccaacactctgcaagcttcatgacttattggtcatgctacattcaaggcgactacagtacccatctttccctaccagaggctcatcaccgtttacatccatggatcggtagttcacacacaacgtagaagcagcaatcattttggatagcagtctctgtcgttttgacaaagcatttacgttaccgcggaatgcgtactgttgaatgcaaaattaaatcgaatagttgactggtaatgtgtcatacagtaaagtaagtgggcctcgattcccgaatactgatcgcagaggatatcccaattgcagtaatggccaaccgcagaagatcgggggaggaagcccatgaggtgttctaacatgtttgtaatccctagaagcccaagctttatccttattttgtttgcaaagggacgtcggttacatatccgaacgatgcatggttcgataccggggttctgacggcgatgacagcatgactccccgaacatgcttccgtgtcaccttatggtctgacaaggttggtagttcattggaaactgaatgataattgtcagataggtctgaaaagaaaagtcacacagattgtcattggctctcaatggtctgagaaagaagagactcttgatgtcaaatgtactaatgaacttcaataatcccaatcaatcaaggttgtccatagttaagggctgcgcctgacactgctgtcaggaatactagtatgttacattttacgatggcagtaaatatcgcaaacgtttactactgtcgggtggtgcgatatttttgcttccttggatggtacgtgctcatggaatatacagacggtcacagaagattctcggctgtgggtagtacattccatgccttccaaacagtcacctccccaccaacgatactttgtattatttgtcctcactaaatgatcatcagttgttttggtcggttctgcaggcagtcaaggctgcagcaagggcatcaaattgtgacagcgttcgattaaacaaatcctgtctcatcactggtcgtcgtctatcgaggaccaacttccgatggttctgaattcggtgacagcatctggcttcatactccgcccgttatgggccgctctaggccaatccatgccactggttcataagttggcagtcgctctctgaagtaacccagcggaatgtgggccccgcttgtcagtctgctgtcaatgtctctctttcacgaaggaaattgctatgatataggtgtgtctacctgatgtattttcattgttgctgatatgacacaggcgtggtgtcaagtacttggattccttatgtttaatggtaaaacatgaaaacattaggtcttacgtcggcatacaaattggttaatggacgataatgattcaaattatcatcagactttgctagatactacctcagccgtgtctattccagccattacgaagccttaaaactccatacacagtgtcagtggaacatactgtcggttctttgttatgacagcagatgcaatccatctattgcctggtatgttccaaatatagtgactgaccgaagtggatgccagaattccttgttatcatcctattgttacaatgaatatcagttcttatccaggaacacattggttgattcctgtaaaactgtaagtttctcttgaaaatacgtcactgacaagactaggtgctttgtcatatagattttcaatgactactgccatattgctgtgtcacggacctctaaggttaagcgtgtagctattttcctgattggatttatattcgcttgataaacataaaataacaaatatactaacattgcgtatcatgtgtcatatcgctaatagtttgttttgttcccttccacgccgttgaagatattctaaatttagatatgaataacgagtagaattcattttagccagatttgctctatatggggttttgcaagcgggtgatccgcaaggttgagagcgggtgtttggcggacctagacagcagtcagactgcgagatttgccgctcggggtgctgctgctacgtactcggagagcagcaagtgcgatgagtgtatgatgaagacggtccgtatgaaccggattctggagttgaacagttttaccgttgatgttgtgaatgggatggcgcctactatggagcggggcacgctggggcttgtcaagcaggtttctgcttgcgtttcatttatgaaagaggcgtttacccgaagggttgttggttgtcaggccttctgcggaatgctcagatttaccaatataacaagatatttggctcagtatgcgcgtccattctaagaaaacaagctatccctcacactctgctatccccataacgtgttgtttagttcttttcatccaacttgtatatcagttccatctctccgtcattatattgatcttaagccttcgtaagatgggataaaagttcgacagctgggaccccctatactatgatgccccatacattgcagcctcaggcacaacatggcatccacggaactggcggaaaacgatgattatcaatccatcgtcgggcaaagatccactcgagtggagaatgacctcttatcgaggcttcccttaaaccgtttcaactccgaattgctggtctctaacgtggatttaaagtggatgggcaatgctccacttctcctgcccctgacattggcctttaaatcccggcaagctgccaccgatcaagagagtatcactttccgtcttttagcactcacagcaccttcctcatgccctacaccggccgttgtaactgcaccagcatctccatcaccctcccggcgcagccggagaggagtgtagcctgccactggtaccacctcaagatcatccatcagtagggaatctggactaatcgaatgttgcgcagcatcaactgcaagaaagctggaggaggctgtatgtctcctttccccgtccctaccctgcagtagccgcccaagactaaaccaaccagccttctcaatcaactacttcatcaatcaagatgacatgaccatcgaagaccctagccaggcaatgaagatctacagcgatcccaatacttcttcggggaacacaattcaggtgggatcatatgcagttcggggacgatagtgggagtttgctgggctaactcggtctttgtagcgccatttctgctctagttgtggaaggttagttgttgattgtgcttcgttcctgtaatgatttgctgatgcagcttggacacagcccactattcacattatcgcccaaggtgccaggaaaggcgtatttgaaggcggcgctgtttgacagtgtgtcaaagcctgaatcggtgtttttcggcgacaagcgggacgagtgggtggccattaacacggcatagtatacagcgatacacattgttgggttgggtggagcattagcggagttggagtccggggttgaatgaggggttgatttaggtgatgatccgggggattgtctgaaattccgagtttagtcgtccttgctcctcgtcgtgaaattatatctcgatccatataatctaggcagaatgtccccaaaatcattacgtcatatccactggcaggtcaattcgcgaatgagattgttcaatcggcgattccttcagagcagcaaacttggaagagcaacaagctctgccactgccgagtatccgaacccaatcagataagcgccggccggggaagcaggggagtcgccgaccaacaaaccaaggaacctgccagccagctgtgacgcctcttcaccgcatcgaccctttccctttcccatccttttccccccagaaacagcaacagcagcatgtcgcacagcttcctgtgcgaaagctaggaagcttagtatacatcatggttgatcgccaggacaatcactctgcaccggacaaggcgatcgctgcagcgaccggtcgcgaggagattctcaccccaccagctgcctgccacacagctcaacgacctcatcgcgatgatgacgacgccagaagcacagataacgacctggatgccctcgaactccgcaatatagccactcaagatgacgacgaggccggcttctcaaccgaatcgatctcctcgggcgaatatcgtatccgcacacatcggaccgtttcccgcaccactcattccaaccgggagcacacaagcaaggggctggcgggacatattcgtcgcttttggacacgaaatgtggtgttgacagtgccgcagaagagtaatcgggaccatttcggtgagtgggcacctcgctttctgatatatacttcgcatattactccatccgacgcatacattcaatactattgatgccactaaaatggcgcaatcgcacgtggctatggcgccagataatcacgagctcatccattcaccaacaataacgcagaaggaatgcaaggctgttgctgacatctcacactatccatttagctttagagcgaactttcttagcttacattcgtacttcggtcatggtcgccatgcaaggtgtattgatcgcccaattatttcgactccagcatttagcttcgccggatacagcactggggttctatgaagcggggattcccctggcggttagctgctatggcgtggcgattttgatagctgccatgggtgcgtatcgcttctggaagcagcagaatgtggtggctttggggactgtgtatgcgggggggtgggagttgaactgtatcggggtgttgattgggttggtgagtttgactcgctgcgtttgagtgggatggtgttactaacaacagtagattattttgacgacgtttatactatctctggttattaccgttgagttaaaacatgaggaaagttagccattctggctgcagctgatgatgacatgccttacgctattgtcttgatgatatacggccaatccactgagcggatatagcaaatcgtcatagttagacaaatcatcgaatatactatgttgatacctaagagcactacgcgatgcagaagatactttgaaagtccaatactagtgcgccaaagtactagtactagtagggggtgttgacatttttatacttaccatgaaggatgccaaaatatatatctgtcacgtcgaacaattagtaacaccgagaccaatccataattaccatgtcctagcagtcctttttcataacagagattgcttctctatactacgtcggagatgtgattataatttcgagagtggtgaatgacgaaccataactgtatacaaaactcgagctggatcagaaactctatcagcgaccgtcatggaagtaaatgctggccggacatagagccaatgaatcaaaacatccccaagcaatggccggatggtgtagttggttatcacgtatcgttaacaccgataaggtcctgggatcgagccccagtctggtcattcttttttgctgtttttcctttgaacagccccactttttcttgagtccgatctacaccgaagccgaagccgattccgtctcaagcatacccaccagccatctaccatctatgtttgccaacaccgttccaaaataaccatatagctgttcccattcggggctcacagttactccgatctattctatgcccgctctcaggcggaagaatggccgagagccagcttgtgaggcatgccgccgacgcaaactggcctgcgaccacgaaacccccgcctgccagcggtgtcggagactatccttgaaatgcgtctatcttgccaatccactcaccaaaggcagagcgagaagcctgcctgaggctgactcgccgactgtcttgagcaatgagagcgagggtgtcccaagtaccaaaacctgcccgggagcccagtcaaccacgcccatcctcgaaagctcagccgagtacctggggcccacgagtttttcatctgtatttgtagaacatcgggatcgattcgaagtggatcagaccctgaaaacgcccactggagggggtatcgatggtgtcggggcgcaatcacccacccagccggggaaccctaccatcacgccgagaatgctccaactggggatacagatcctacaaaacctgccggatgaacgaacatgtaacttacttttcgttcatccgatggctttgatggatgcctgtttccgaccagcttatcgagtcgcgtctgataagatgtgggatgagtatcgagacgtgctccggctgcggaacagcgagcacctacagtttgttgcgaagcggttttcagagtgcagtctaacgcctttaccggctgtacaagatccacaccgctggatcgagtctttctcgggaaagagaactcgttgggagcttctaggatccttgttcactttttggtcgtctgcagcctcacagttgccggtacagcacgatatcatcacccagtactgtcagcaacatgcgttcaagagacccaaagaccttatggtgcatctgaaacggtgtgcgtccatgtgcattgagctgtgtagtcagctgggtgcaattaatattctttttgtcaatttggcgttcaaacataacatcctcgagagcattgccagtggtgataagagtaagtcctaacccggagatatccaagcatagcacatagcactgatcaacaggcctttcttgctggcgccaacatggcgatgtaattgcagtcacgacatcaatcgggcttcaccgggaattatcatctaattggaacgaggtttcattccagcacgaactcaagcgacgagtctacgcatcgatttacaatttcgacaaggtcatctccacatttaccggcagaccaccgctcctgaacagaaagtactcgacgaccaagctgccgctggacattgacgacgaggatatattctccggcagaattggcgatgccgtggcaaagctcaactcaaatggttgggacagcagcgaagaccgacagccgtatcctgccaccatcttgcgggcgcgagcaatgctagcaaggaaccgcgaagagatgctagaagttttagagacttcgcaggatagcatcacagatgctgcagttcaaacatgcctgtatgacttcagcccaatctgtatccctcgcacttgcaactgctgacaagcaaacagccacctcaaagcacaagctacagacatctacgcacaattccccgaagtcatcaagtttaaagcagaacacgtccacgaccgcgacatgcccggccagctgctcgctttgcgtgtccttgtgcgcttggattttctgctcaacctgttcatcttagagcgactactgacccgacacagggtggttgacgagcaggcgctaatccaggttagccatgaaatggtaggattaaccttgatatactggaagcacaaggaccggttcgagaatcacgttgatttttcctggctggtatgactcacagccccctttaaatagatacacctcatcaatactgacgcgacatgctcaggctatgtcctacgccgtcccaggcagcggtattctctgccttgagctgctccgccaatcgagctctcccgaaacgtacaccttagaacttccccgatcggacatcatccaggacctcagtgtactggtcgccttcctcgactggctccgcccctcggaatccgacatcgcagccaaggcgcaaatcaagggaatattgcaacgctcattggaccgaattctcagcatgccggcatcgctgcacagtccgacgagagccctggacgcgctgcccgactttgtaggcgcagatccccatctcgacttgttaaacacattcgcgtgggtagattgggatgccgcattatagccatattcagctctatacctactatacatctataatctagtataatctagcatgctaatgataccaaacccaacgctatgcaacccaaaaccaaaatcaaacatcccaacctcccagccccaaaaacggactcatcatgcgcaccccatccgcatacaactggaccaaaatcggataaatccacaccggcaaagtccagagcataaagaccgcaacccaaacaaacccgactcccctcctaacccccctcgacaagaacacactcaccggagccaacaacctctcagcaagcatctccccggctacacccagaatctgcaacgcgaagaaccacaacgccccactctcatcaatccgcaccccgaacccgacatccatacccgtatgcactaatcccgaaacaaggaacgcgaaaataactcgaaagcaccactggaatcggaccggaaggcgcaggatagagcccgagacgaaatccgcgttcgagcaaaggagttggcggagggtttggtgccatgttttcctgtagtatcacatacttcattagtacaagaactgcaattatgaatgggaggaagatgtatgcatacccccagaacctcctaatcgaccacgcatccagcaatccacccccaacaggcggccacatactcggctcctggcccaatgctacagccaccaccgcggcagcggtataccccgtgacgatgaatgcgcgcgccacgatcccaaaggagagagtgaagaggaaccggaggaaaagatcatctttcccccagccaacgtgataccagggcgggaggaggatttcgtccggccgaaccggtaatttatccactgcgcggccgagatgcggatcggtggtctcgagggtgaatagttggatgattgcgatggagatggtgagtttgaggagggaggtgaggaggaattgtgtccgagtgggggttttgttgaatgtggtgagggcgtggatttgccagggggtgttgatgcggcggtagttgaatgagaggttcagggaccagagatatttatctatgagcgatttcgtttgtggttcatgtggtgatttgtcttcggaggttttctgtttggtgttgtatgctagttgtttatcgtagtccgcgcgcgtgagaaccagtaaatctatcccgttgagaacattcatccagcacattgcgacgagcggagcgccgaagcgggtgccgtggaggtgggcatttgcgctaatttgcatgcagtaggcgaggatgagtacgacgagggaggcgattgatcggaggggagagttagcgggagtgaaggcgacagtggtgccggttaggagttggatagcgaggaattgggccggggggatccattgtggcatttttttttctggttttctgattttcttctggagaggaaaagacgggaagataaaagaacgcaggcgtgggggctgggagacattattataagctggggggattgtgggtttggaatgcggctgagattgaactgcagagctggattgcccgattgggatagggtgaggggattgattgggcggagcgggtcggatgggtgagactgatcggcgactagcgatgcccgtgcagcaattggcgattgagatcgagctgcgtgggtcaatgatagtctacactctggtagtgctggtagtgctggtattgtgtgtaaataagtgagatctacaatggaggagtcatagaatagataaatgtacaatgtatgacgtattctaagtagtacagtgaagtgtagtgtaatagacacttattatatacaaaacccatatctgttgcacgtgacacaaggcatccagtctgtccagggatgatagaaaataaagtaatacagtaagaaagtatgtcgatgaaagaagatgacagagcaaggatgccattggcgaggtccagccgcagcccgtcacgagctacacaaggaatgctgcaagcttcgccgtgtcagctaaccagcccgctctgcagtggtcccgctccgtacaacggccagcggcgccggccaaacaccacgcgaggaactctcttcagactcttcatgccgccgccgctgccgctgctgctgctggcagagcctgccttgtctgcatttgatgacacccgcgtcagcccactcaggtgctcgttctgttggctatcggcggcacgacgcttgaccatagcccgcacagcattggtgatctgaacacggatgagaggaacagccgttgcctcattgggtgtagagtgataggaggtggtaaagtcatcatcgtcttcttcatcgaggtggaaagatgccatgcgccgacgcacgtcttgctgggcggcttcaatggagcggttgaggagagtgtggtgagcaaggcatcggcgcagatcagggctttttgtagaggcttccttgtgaagcttgtcgcgggagagagcagccatgcgacagggaaagggcgagacggagcgacgagccatggggggaatgcggctgttggtgcgggtggcctgacgcatcaggtgaggaggaagttcaataccggccattgtggttgacgttgtgaagagtaaatgtcaaaaaggtgattaatgtagaggagtgctggtgataatggcactaggaggtagtcggtgtaatttgtagtcgtcgtgttattgcatcgagaatatggatgtagtatgcgaatttgatttttctggttataatctgacttcaaggtcaggggcaggatcagggcaatctttataattcttcccctggaccagcaactcgtgaattttgaagatagctcgcacttgcatactctgctcagggctggtggagtctaggccattgccactggcggccgagtccgacacccactcatccatcggccgtgaagaaagtaaggtctcgagagctgtcaaaagtgcaatcagtgcaatcaggtgcgtctagccagcgccgactcttggcgggcaccggccgaaccccagacttgagagagcttaggccaacggtgtcgccggccggtggcgagcaaagtttggtctttgcgtcattgacttggaattccggccgctaatgggttgaactcgggcactgcctctcgagactgggttggaaaatgctgcagtctccttcatcattgggtaatgtaagaccgagtaaagcctattattcatgtactattggactaacctgctaccccgggtgttttgtcccaatagggcaggtcaatgtaaagcctagatgttgttgcctcaactgtcatatggtatatcctactagatctgtcagggaaattttatgcaggtattgaatgacaaatatgctcgtatccaagccttatgtgcttgtcatagacgaacggcatgccgcagaacgttgaggaatgtgaagttgatctagcagcagcccaggcctctcttcgatctcgatcgggtggataagtgaataccccagatcagcgtaatcttcagcggagtctaagaactgggatcaccattatctccaatatgaggctcatatctccaactgatatcaacaccagactctattgagtatagtatagtcatgaccagcgacgatcaccttcacattcccacatggcccagcaggtaccggggggttatagattatctaattcccccccgacggcagaatccccaaaatccacccatcagcattgagaaccaagcgtctttgttcccatcagcgcgtgcacgtccttcggcgacgccgaaacgcctttgaagacgagtcaagataaactctatcaccttccacaagcggtaatcgctctctgcgttgaatcaggacctcctcgttgatctgagagccgcaagcccatttggtcggtatactccggtcagccctaatctgtgcagatcacagctacaagaaccctcacatagggccctcggaaagtccccgtgcagaaccactcgctccaccaagattaagaaaaagtccaagatattagatattactaccagtatatcgagatatgagatcgatcgaggctctaaaacggaaaaaagatctaaagcaaaactccacttacacctaccaccacgaccatccacagtgcccccatccacatgtccatcccacgtcctcctccaaccctcacactggccgcaccattctcctccgacaacgaggcgcgcgacgtactagcattcgacacattcgacatggccgtgcccacccacgcattccagttcgtcaacttatccggacactgcgtcgtaatcttctctccaatcatctgcgccacgaacttcccattcctactcaacgtaaccaccacctcacccgtgcgattatccatcggcacactcccaaaatacaaccccctcccaccaccactactcccaccactaggcgtatccgtccaacccacggacttattttccccaccaccaatactcacctccacatctgcagtatcctccaacaacgcctggaagaatacttcatccttcagcacctgccccggtggcatcgtttgctggccttgcgtgaccgaattccccgtagtcaagcccgccttacatgcccacgccggcgtaaccctataccaaaccaccaccccttccttatcaatcacccccttcccacttccattcttgtattcacccaccacatacggaagaaactccctccacgcgtcatgcaccatccccgacgcgtagttgaacggcgcctgcccgaacgaaaatattcctagctcgttctcatgcaagggcccgatgtaatgcgattcgccgaagtcgttccacgtaagaatctccacgaactgcggttgcaggtcgagcacctgcttccaccgcgtatgccacagcccatcgccctgccatacccagttcttgtggtaccgtaccatgtcggtgtagaaccatggactgacgggcatgatgtacggtttgtccttggctttcagggcggagatgtactgctcgtctgtggacgtgttcatcggcgtggtcccgtacggccaggcgctccaggagagtaacccgtccacagcgtcttcgctggctagttcctggggggttcgtacagaccattcgggcatgaaatagatattaggcagtttctctttgatggtggaccagtcggccagggcttcgtagccctcgaaggtggagaccagtgggtgcttgttgtcgactcggtagtaggctgtgtggttggcgtagccttgcaggactttcaggacttggtctggtggccagtgcccgtcgccggagtagtcgagggacaggaagagtttgaagtcgtgtgctgccgcgacggtgaaggcgtctgtgagcagttggtcggtgttggcggcgccatagccggtgttcagggcaaaggcgtcgatttgggctgctttggcagcgcttatgtcgcgcgtccagtgggtctgggtgaagttttcggcgttggcgagctgggcgtagggttagtgggtgatgtttggtagggtgtgggtgaggggggaaacggacgatgaagtgcgcaaagacgtctttggcttgcacgtggatgctcagcgccacgaggacgagggcgagccagatgatgttggccatgttgcctggatggctatctggctggctggctgggacgagggtacaaagtccttttcttttctatatacgtcctgcgacctaagtcatggtcgaggaagggggaaacgagcgatacataagtagtcgggtagaattgacatagtaagtaagtgggttgccccggaaattttacttcaatgcattgtgatagtcaggagataaaaagtgagctatgtgaactgtaactgagaaaagcagtagcctagtgaacgcgcagcatgcagtgcgtgaacacagttgtcaaagcagacagggaagaggaagtagttgatgagaggagaagaagaaagaagaaggaggggattatcgtcccgagtggactccattgcgtaggctcatctcgtagcggtcaaagtcacagaggctcggaggattaggcttcaatgcttagatgagatgcgcaacaaaacagagttcaatgttttctcgtaagtgaggaaaaatcgagtatgagtaaccgaggtttgtttttgtggaaggacgaggcatacgatagttgggcgaggatgaagcttgttgtcggccagcgtgtagcgcttggtaagtagactggaaggaaggggtagtggaaaaaaaaacaccccggattgacagggccacggaccgcagtggctgttgattattgatagtcagactctgactactgcattgtcaatccgactattgattgtctcggatgtgattcatcagctgcttgctgtgtgtctgagcgactttgcggaactcaaaaccctaaaggggccgcgcgcgacgcggtgaatgcgaactctgcctctctatgaacatgacaggtcgtctatcaatcagactttcggattcggttagccctgattatagccagtggtccccgattatcttcagtgagtgaccgatatcggggaactgtcttgaacgttgtaagattcaacaacgttgttagacgatccggagatcgctcggcgccgcgccaccgggaatgcgaagtgtgtcaggattgacctcatcgagggccaaatttgaagatttttcttcggttccttttggattactatccatcaaagcccaccgtttttgtgcactatcctcctgtacaagctgttattacattgcagccgttcaccggagtttacttttatcggtggagctcgactggtgggttcatgcaccgaagggcgtccggtactgcgagggcgtggagcccactacgcggcctatcaatactggcaaatggtcgcccgcagcatgcagccaaatagactctacgtaagggaggaggggttcgttcgatgcagccggaatagacagctgcattgacgcacccgggcacgagctcgttggacatgctggcgattgctgccgactttgccagccaaacccaccagctacttttccttgattcatccccgcttaccgctgtcagctttccagagtaaggggaccgcctgttgaggatgacttggcactgacagatttcacaaaagtagctactaatactgggcagaacaaggataatggctgatgaaggttttggagaggagctgacgtatcacaggcagactgacaataaagtggtaaagtacaccgcgcacgaatgactggttcaacagaccgcatgtgttttccccgacttcccctgaagcgaatgctgctcgtttccatacaccggatgaccttgtggaccgcgcgtagcatgtgtctggatgtatctgctgggtgtcagtttatgcccggtcgcctccagagacagaataagataaatcacgtacgtgctgtaccgcttgaccatggtttcgtccatatcctctagcgtcttcaggcccagtcggatgtcctccacgagcaggttacaccggtgcaagctgaagtcctcgcgcagcacgatccgcatcatcctcagttgattacacttcggggccatggtatacgccggaatcacccatccccggcgacgcagcacatgggccagagcgaattcgtcgtacagccgaccctcttgttcgggtaatcggaatgcaactagaggaagaccccgacctccaccctcgctcatgataataaagccgagtttctccaactccgctgctagatggtcggcagtctgcgtgaggtttgtcatgatcgatcggaagccatgcttgcctagccggatcagttggtagtattgcccgatgacgtggggggcgcctttggaaaagttcaacgtgaagctggcctgctcggcgcccagataattgatgttgaaaatgagctctttgggaaggtattcgggggcgcgccagaaaacccaaccaacgccgggatagacctgtcacgatcagtctgtgtccgcattcggcgaggtgtactggtttatgatgtatctcaccagtccgtatttatgtcctgagacatttatggagatgactttttccaggcggaagtcccactccagctctggtttcacaaagggcaccacaaacccgccactagccgcatccacatgtattgggcagtcgatattcttcgctatcagcaggtcgttgatcgccttgacatcctcatactgccctgtgtacgttgtccctaggattgcacagattcccaccgtgttttcatctaccagatccaccgcctccttggggtcaatgacatatcgggtctccgtgcaatagacatatctctcctcgacctcgaaataccgcgctgctttctcccagcatacctgtaccgcactattcatgatgatgttcggacgcgaccagtccttcccagcttctttccgcttgttctgccagcgtttcttcatggccagcatggccagcatgatcgcttctgaggatccgaccgtcgaagtgccgatggcgtcttgctcgttgcttgggtcattgatactaggtgcatggaacagaccggcgatcatattgacacagcggttctgcatatgcgcagtctgtggatactgttcgtagtcgatgaagttcttgctcatggcgtcggacatgagctgttgcacttcatcttcctgtgatggtgttagcgggagtgttgggttaattttttcgaaaacagtcttaccatataggtagtgacaaagcttgctaaactagtacatgttactattgacggctcaaagagcagaaagagaagcgaggtattacttgagcaggggattcccatccaagctcaactcatccttgatcatgcgatatgccaccggggctggcatctcattctccgacatgctatgctccggcagctcttggactgcatagcgcgtcccgtacacgtaaggtgacactgcggctgcctgcgcatcgcgttcttcgcgctgacgctgatgggcgtgggactctttacggacggtcgacaggtggaccattctgacggcgtttcagggaataacaatgccaaacacgaggttgaattagattttgctattattggcagggcctatcctgcccgaaaatgagggcgacgtggccgtcgacttatatgagggactgtggttgcaccgaaactttgtgttcgggatgacctcaccacatccgtatccggagcccccggttgttcttaggcgcagtgtatcttaggtacaacctaaagagaggcgtctggaccaggaatgtgttatacaactgctattccatctcctcatctcgtgtcggtcctccgtagatgcctgtctcacggagaacaggcttaacatgaaagctgctcggaaataacgatgtaaaacaagagccatgacgccgtccgctcactagagtgttgtttacaacttcatcaagctcgtagctatgagaaggcagtacccaggaatggacatctggcggacagcctagccaacaaagcaaggcatcgcgttgatggcgatcggcgatggcgatcggcgacggcggagttagcggcggaattaagcggcggaatcattgcgtgtgaaggcctcaggcaccaaggctgcagtctggccttgctcgaggcagtcaattccgccgcaaagtccggcatcgcaaaggcataaaagagccgaaatgacatgttgctgggggtgtcattttcgatagagacaaaatcttttagcaattatcattactgcaaaatgaccgctttcagcaaacttcctgctcgctctctcggcaacaatgccccactcattccgcgaatcggcctcggactcatgggtgccagtggcacttatggtcagcctcttccagaaactgaacatctgaatttcttggacgaggcatacaaaaggggtgagaccttctgggataccggtatgtagtcgtggatcccttaagatggacagattctgacaaccgcagcgggcaaatacgatgattccgaaagcgttctgggcaaatggttcgcccagaaccccgacaagcggaaggatatcttcctagccaccaaattcggcatttgcactaatcccgaagccaaagatggcatgaagaactggatggattccagtccggaatactgtcggaccgcgattgagaagtcattgaagcgcctcggactgccatatgtggacctgtactacgtccatcgcttggacaaggtcacccctattgagaagaccgtcgaagccatggtcgcgctcaagcaggagggcaagatcaaatacctggggctgagcgagtgcagtgcggattcgctccgtcgggcccatgcagtgcaccccatatcgtgtgtgcaggtagaatacagtgtcttctgtagggatatcgagtcccctcaggtgcaattgctgcagactgctcgcgagctgggcgtcgctatcgttgcgtatagtccgctcggcaatgggatcctcagcggagcgattcggtcgctggaggacgtcagtaagcccggggatgtcagaggcgtgcttccctggcttagaaaagggaatatcgagaagaatgtggctgtggtggatcagctgactgagatcgctaaggcgaagggtatgaccacggcacagctggcgctggggtggttgttcgctcagggggacgatgtctttgcgattccaggaacaagcaagattcatcgactggaggagaacttggccagtttgtctttccaattgtcggaggaagaagaacagtcaattcggcagatcgcccaaaatgtcgcgggtgggcgctttcaggccttgactggttttgcctttgccgataccccacaactgtgagtggcatattgggatatgtcttgtccctggatagtgtaaggattgtccaaaaagaagcccgcgtatatatagtcgtccctttccaactctttttccatgacggatgtcaaacgtgtttatttgattagccttcgttgaggacgttcggttcaagtgaccagtcataaagcaactgcatctcggcttgaagattagacgatagagcgagctgagaattcaagccacaatcaaactccagttgtgtaagtgtcgaagggagaaggccttgtggtcctgttgcctgtgcggaccctgcgagtaggccatcattttgcagatttggaactggcccaggaataacgcagataactccaaagtacggaatggaaaacttcaggccttggtgagaagtaccgcacagggcatcatctgaaccaacactgtccttttcaatgcatgaaatgtaaatgataccgtcggctgcctcagcctcaatactcaggagtttgctcaacaaatttcttgtttggatcgcagagtctctatttgggtcatttgacgtgcagagttcgtccaaggtgtcaattgcctgttgaatcatggccaggtcttgaggccgttgatgttctaggacgttctcggagcccgaccggtgtcccaatatatgagacaagagcagggtcactgctgcgacgaaggctttatgttcaagccctcggtaagagagaataggccgtatattccggaactcgagacagcgactcagtacttcacggcttgcagggacgaccacatgtctgctgtatgagtagtcgggaagtataggtgagattgctgatggactgaaatatgtatggttactcagctgcagcaacaagtacggttgatgaaggaggatcacgagataatattggtgcatctgggtaacaagcatggagatcctgtccatcttatccgtatccaacaaagtattgttcaaggtagggaccttccagcaatcaataggcactgatcgggcactcttccttagttcatcatttatgccgcgagtcaccccgtaatgatcatacgtggtatccaactgtctttgggacaacaaattgtaatgctgcagacgcacatttcggacgattatccgacctgcgatgacagaatggatgcggtataattttctaagaggtgggtaggtatctaaagcctgccaattcaggagctcgagatccttcaccgcgcatggaagcccaagcattagtgacaagaaccgatcattatatacaagctgaacccaaagggattccgcgcggctgccggcttgttcattccggcttggaagtccgatcagttgagcgatgctcaaagcacgacggaaaataagccaggccgagcgcagctccccagagttaaggtgatagcgggcctgcagtaagagagtgtcaagaccatcgagagaatctacgagcgcgtcctgtgatgttacatgactaactgccagatcgacgtagcgccgggcagagtcgcctgtggaccacttttgctctagctgcagttgtgggtgtagacatgaggcgaggtccagctgctgtaaaccgagtgcaagttgtatgagtttctgagcaaattggattggatgggaagtagaatatggtagcctgaagacatctccagactgtgctaggccagagcagacagccgattggtctcggagtggggatcgacaagtctcgaaaggcagactgaagaagcgacccttggtcaagatgagtgcggtcgtgttcggatgagggaataacgccgccagagacttgcacagctgctgaaaggggaatgatatagatgcttctctcggccgaggggaactcgctcggtcgcgaaccccgatcacaggctggacctgaggctgacagctgtcacgctgccgaatcaattggttgaccagagattcgacgtggcaaatccgctccgatatctggccatcgctactgtggcttcgtggatcggcatgttcctggctgacgcaggggatacctcgagactggcaatagacacaagtggagtccttgaggggctcgaacacgcagcgtcgcttccgatgcttgcactcccaacaggagaaggtgcccttgcggattttacgtcgcttggacaccgagggcgagtgccctgatgccggcgatgaggcggtgggcatttccgggaacggggttgatacaggaagataatagtagattggattaggggacgaagtgtctgtcagagaatggtggggagaattggttgccatgcgatcggcccgatcaccggcgctaagcgcaaaagtcagacctcgagtgagtctgacaggatagacatgaaatgaacgacaaaagaatgtgctgtatttctctattttccaggttgtgtatgattaatttgcatgtattgctacataaattgccatgctttcatcataaatatcctcccagttgattccttggcaccctaatcgaagtcgagaatctcgacgctcaagcctgggggaacatgcacatttttcagttcatccacatctacatcgtcaggcgcctcgaccctgctatcatcagctatgccccagcaagaataaggttgatgtgacgcacgacatgaagtgaatgggtggggtggtcaatgtggagtcgaaacactgggggaactccaggtgtttgtctttatagacgtcctggagcctatagagtcacgtttagctatcactgcgcaggcaaatcatatcgcctaacatctcatcttaccgcttagtgagcttgtccccatccccgtagtactcatgagcgagctcgttgtcgtagcggatatcaaaagtctcggagtgcgccagtcttgttagcatgaattcgttggcacagcaaagtccgtcctacttaccaggcctttagtcattttgcttcacggaatactaatagttgaccatatagatggatggagacttagggacttcgactgcctggatgattctttgctcttatatttccctgctttgggctttcgacgtcgagaacatgtcctagactagatccagatttcctagcttcctctatagtcgcttcgattggcactgacgggctcttcgcgtgtgggcatgaggtcactgatacctcatgaactttgctgagcgcgtccatgatcaggatggccgcagtaaagtttgaagacccatgggtgggagtcaccgggaagttgtgacaatgccaatgactggaacttcgcggaaatgacaggctgttctttcattctctttgttatcttccgacatattcagctatggagaccctgtccttggaataaatctgcgcctttagtggatgcagtgaggaagttactttcttagttgttgcctcccgcatgagcgtcggtccagatcccttgatctagcaaactatcacaagaccgcacgggaaaaaaagttaactctggataagctatggtgatatgaaaataagtggaatggcacttctgtgtattcagtttcatgacgcagtaatccgttcctatcgaggcctcaaatagctcatcgttcgcatcggttttggtcattcctacggtcggaagccccgtatccatgcccgataaatcaagacaaaaaaacagaagtaaaaaaaaaaaaaaaagaaaagaaaaaggagtgagaggagtgaagagggggcgggtaggtgccactatatggtgcttgggcgacattcgtgttgtagataaaccatgccgtttgcggcattcgtgtcaatgatggcaaccttaactctatatactaacgcaccattgcgcttctgatcatgggtaaggtttcctttgcaaacttacctaataagcaaataaaataagccagttacaagaattgagatggaagctagataatccaagatgtggccctggctttccgacccaaggcagcttacagatggttccactgccattgccttttaaggtcaatagagggcgcattgtagttgtactcggctcatactctgccatccggtatgttcatgatctgagggaggaaagaattttattgacttgccggtctggagttctggtttagtggtcattctgtcctgacgaggccagggaacagcggataaatgccagtccggctattgttcccctccatttgttgatgccgccccccacggaatgctctattcgtctccattgatcacgccttttctgggagggggatgcatgaggaagccaataataacggcatcttgacttggaaaaccctgtaggttaatgattatcaagcccatattaaagtgttgcagaaccaatcgccaatccccttctctccggcggccccatagtaaaagcccaagcgcagtattcggcatacctacttggtatgttgtcccagcattcccgaccaccggcatgtccccccacaagattgcttacaattgcttatattccgtgcttatattctgtgaagggagggccgaggggccgccggggaaacctcgggccttttcctttttctgccttcccgatcgggcatcatggccaactccggactgcattccgactcttttccttgtatttctagtagtttagtctctggttagtggtgatgcagtaatactcagtagtgaggtagggcctgtgggatgacgcatagtctgttgggacttggggaagggttttcgttcccctcatcttcttcaccccaacttttccccaatattattattaatattctcgtgcatcatgcatctcccacgtgatctgggcatattaatccggggttgacagcatcacttaacaatgcggctctttggacaaatctaccacacacagtcatcctcctttgccattctcacgtagcttccattctcacgggaacattctgccctccctcccggattcttcggaacgagagacgggtatttgccgggcacatcgtgggggttcctgccaagccctagcggggtcggaccgcattggcattcaactcaacccggtcacctcgagagatgtattgcgactttgagagtcatgccaggcgacccgactcgtcggccaccttcattccggccgacagaatccattacctctacgtcattacccacggggttcctccgacaactggggctgctagctcccacagggtagaaaatgagaggatcctcatcaccaggaatggcaccattactgtctgagcgttattttccctttccctccaccggcaaaacttcggcaaaggcctaaggtgaccgatggagtaaggcaaacgaagtcatcttcctccgactgggcagaaacggcccgtggaaaccttgcgattggcatcgcttctcggctgtggagtcccagctcggcacgaggccgaccccggctttttagccctcattcaacccggcattgcgggcctccgcattctccactccagcagaacccgggaatgcgccgtaaccggccagggtttgtgatgtatataagggtgcaagtgtcgggggtagacgatgagggataggagcactcaaccagcaacttcacgagtccggctcatacaacaccatgaaggtcccggccgaccacgccttgctgctgtccagcctgctgctggccccctccgtgggtgccagtacttgtcaggaacctataaaccacccaggcgagccattcagcttcgttcagcccctcaacacctctatcctcaccccttatggcggctccccgccggtattcccttctcgtaagtacaccatgcctgcgtggacaaccatacccatcatgcttactttgtcgcagctgaaaccaagggcaagggcggctgggaaaaggccatggcccaggccaagaactgggtatcgcagctcacagtcgaggagaaggcctggatggccacaggtcagccgggcccttgtgtgggcaacattctgcccatcccccgcctcaacttcactggtctctgtctgcagaacggtccccagtgcatccagcagggtgactactcgagcgtcttcgtcagtggtgtgtccgccgctgccagttgggatcgcaagctcctctacgaccgaggctatgccatggctacagagcacaagggcaagggcacccacgtcgtcctcggtcccatcggtggtcctctcggccgtagtccctatgacggacgtacctgggaaggcttcgcagccgatccttacctgaccggtgtttgcatggaggagaccattctcggtatccaggacgccggtgtgcaagccaatgcaaagcactttattgccaacgagcaagagacgcagcgtaaccctacctacgctccggatgccaacgccacaacctatatccaggactcagtctcctccaacctcgatgaccgcacccttcacgagatctacatgtggcccttcgccaacgccgcccgcgctcgcgtcgccagcttcatgtgctcctacaaccgtgtcaacggctcccactcctgccagaactcctacctccttaaccacctcctcaagaccgagttgggcttccaaggctacgtcatgtccgattggggtgccactcacagcggtgtcgcctccgctgagagcggcatggacatgaccatgcccggtggcttcactgtctacggcgagctctggaccgagggatcctacttcggcaagaacctcaccgaagccatcaacaacggcaccatcaccaccgaccgcatcgacgacatgatcgtgcgcatcatgaccccttacttctggctcggccaggataagaactaccccagcgtcgacgcctccgtcggtcccttgaacgtcgactctccccccgacacctggctctacgactggaagttcacgggccccagtaaccgtgacgtgcgcggcaacaacagcgccatgatccgcgagcacggcgccgcctccaccgtcctgctgaagaatgagcgcaacgccctccccctgcgcaagccccgtaacatcgtcatcgtcggcaacgacgccggctccgacacccagggcccctccacccagaccgacttcgaatacggtgtcctcgccaacgccggcggctccggcacctgccgcttcagttacctctcgaccccacaggacgccattacgacccgagcccgccagtacggcggcagggtgcagacctggctcaacaacaccctcatcacggagaaatccatgcccgaactctggaatcccgaacagcccgacgtctgtctcgtcttcctcaagtcctggtccgaggagaacgtcgaccgcacctacctcactctcgactggaacggcaatgccgtcgtcgaagccgtcgccaagtactgcaacaacaccgtcgttgtcacccactccgccggtgtcaacgtcctccccttcgccgaccaccccaacgtcaccgccatcctggctgcccactaccccggcgaggaagctggtaacgccatcgccgacctcctctacggcgacgccaacccctccgctaaactgccctacgtgatcgcctacaacgaatcggactacaacgccccactcaccactgccgtggctaccaacggcacctacgactggcagagctggttcgatgaggagctcgaagtcggataccgctactttgacgcccacaacatccccgtccgctacgagtttggcttcggtctcagttacactacttacaacctgaccaagctggtcgctgcgaagcccgtggcctcgaacctgactgccctgccggagcagcgtgctgtccagcctggtggtaaccccgctctctgggataccgtgtacacactcaccgcccaggtgagcaacaccggcagtgtggacggctacgccatcccgcagctgtatgtcggattccctgataccgcgcccgcgggtaccccgcctagccagctgcgaggattcgacaagatctggctcgaggcgggcgagactaagaaggtgacgttcgagctgatgcggagagatgtgagttactgggatgtgacggcgcaggactggcgcatcccggccggagagtttactttcaaggctgggttcagtagtcgtgacttccacgcgaatgcgactgctaccttttttaggaagtgaggcggggaagaacgttttatgatgtgatatgtaactagcatgaggcatatgatttgtattttatgatttgtagatagttggctaatctagttatgtctgagacacttgtgattgtggatcggtgctgatatagttatgtatttgacacccagaccattacgggaagattccagttgatctaatcttccctgagtcgtaaattttgatcctttctctggagaaattctgcctggagactctgatcaacgggtttggacgccacccatagaaccaacctaaacccggtactatgaagaacgaccaacctcgccgggtcccttctccaacttcctgttggcagtctgtctgccttgtcgtgtcccgtccctcacaaggccgaaacatttccaaatgaccatcttatgtctgcttcgtcgacgggcaagtttatcaccgttgatgtgatggacacttttctttcacacttcgccggtgcgtcatgggcctccaaaactaggcccttcaatatagaagtgccctaggtcggtgccagctcgacagccccataacttcagccccataatccccaagggaccgtaaggcggacgatgccattccccagtcagcacatccatacggtatctcggattcctttgagcctgagtcaactttcagcgaccaaggcagattgtccagagatgtcgtttcgacatcggcactcgcgcccttgtttccatgataagagtatctgggttttttaactcttaaatttgcataaagtatgcatcttcatattttagataaatatatactttgtaccccggggcaaatcaatccaaagagagtcagtcctctatcaccaatgaagtgaatcatctggagactcggaagaaaacgagatacccttcaaaatcagtgagcggactggatcgcttttgaatataaagcacagctacaattgatcgcggatgcccctcgtggttcccggttggacgctttccgaaccattatccaaatggcccagtcgctgttgtcttgcagtatctatcaggccgattcctgtgtaattgccagcttttatctagaaggccacgaaccagcaagccccataaatcgggggaacaatcctgatgtatatgcagggccttttaatggacgaagtcatccacgaaaagtgcgaaaccgaatacaaccggttcaagaactgaatggaagaacacttgttagaatccatagctaacacaatggctaacacaatgaaaagttacgtaccctcagcatatttttctcacaagccttgccatgtccctattgcagcttagctagggaccataccagaatgggggggagacctaccccagctaccaaattcggaaggtggcataatccatatccgcatttaggattacttcgctgttctgtactctggcagatgaccaaagagtgtaaagggggctgctttaagctgtagctgccaggcgtaacatgccaggtgtactgaaaggcgacgccgttcaccttaggtcatagagtgtgagagcttggatttcacgtatcgtgaagttccaaagaaatggggcgataagggttcgtgttcaagacgtcttcttgaacaggaagactgatataggagtttcaaacgcagtggacatattagctgatggtatatgttgcagcagtgaaatagtccaaaatctgaacagcagaagctgcatatacaacggcgtttcccagagtgggcatcttgaagatgttaaaatcaccgagtcgtggagttcaacctcggcaataatgcataggacccttcctctgttttcttaaggcggtagtagctgcccaaacaaacaatgccggggcatgcattgctcatggtctcttgactcagcagagcaataaccctattatcttagcgaccgaagaaattgtttgtcaaactttgtgatccgctgctgcttggtggctatatgtataaatacggtcgctgagagagattatttgctaccccgttaggacgtatggcctttgagtaccagccttggctagtgttcgttgtagcggagcagacgtgaagtcaaaaccagtcgcacaatacatgcatagtggaggaagcgttgtccgcgagctccacctcttataagaaattggcaactgaccaacagcagatcccacttcgtcgagacagatgattatataacggtcggctgttgtagggagaatgataagtccggtaaaagcagataggatctcgcatttgaggacataaacctagcctcttttctcgaactgttcggtaccttcatcgtggatcagcagctgcgccgaattgccaaccttcctcaacccttgggagaattttgcacgcgttcttcttgcttttggagcacagtatatcctttggtccagcgaagtgtctgcgagtgtatcaaaaggcgattaatcgaaggaatgaaaggagttttgtgtctgttgtgaaccggagtctctctagttgtgccctgatgcgttggaccaactggaaaagctctgtaaatatctgttcagaagtaatcagacactgtagatgtatagatgagaccacaggatagtcacccagaagagttgtatcttctttccctctgcgtcctcaattcccgggaagcatgatgcatacaaatgacagtgcagtgtgttgcttcgtgacccgaatctgtcagatatgaggtatatatgaagggtatctagaggctgatgtgaatagttcctctgaatattgttttgtatttccgagatttcgaagtattagacaccactgataagagaggagaaatcagagcgacgccgggttgagggttgtgtcaagacatgcttggtatcacgaggctgggttgacaattgcagtcgatgttgcaactgattctcattgtcaatcaagttaagcaggagctctcagagaacaagtgttgaactaaatcttgtagataatatatatgatatatgctgatcgatggaagaaaatctatcgtttcgaggatgaactttggcatctggtgaagattatatgatcatgagagtaagtaggaagaagaggagaagagtggaaaagggaggacgacgagctttatataaagcagtcaaggcattgtattgttggcgaattcagccggacggtgatgtggtatgaactgattcaatacagctatcatggaattgcgccgtggtgacgctggttattcacgaggcacaagccattttgcgctattgtatggcggtcatgagtaatggaacatggagcagttaatctctccattataatcattgtattagcatagggatgctaagcttcacgcacatggattaactagctctgctgtattgtgattacgggaccgagttggcacttctacagccaacaatgcagtctaagaaagacctcaactgctagatcgtcatgacgacgcttaagaaaggcacacttcttcacacaaaaccagcgggtatgtagccgaacagaaaactcctaaatattatagcaacgtgaatttgaatctatatgaatgctcaatcggtacgcaccagcgtatccacctgccttgcagcagcaatcgacctctctaagacatccaactcctccttcgtgagatccctgacctcaccaccgaccatacaactatgatcctgtttcctcgacccttttacccactccgcatcgatcatccacttatccgggacctcatagacatcctccatcccagcctgtcccttattcttcaacagactcccattataccacaacagtcgccccttggcatccacatgcgcaatcacgaaactacatacaccgactctttccttatcatcgacgttcttccaccccacgatccctccataatgcttcgaaaactcatactcagcgcccgacaactccaacccgaaccaccagctctccttatctccatacgtgatcttgtacgtagtttcctcgcgcacttcgtacgtattctgccagcagatatgcaacaggcccatgaacgtatcaggcctacttttgtcgagtaccacgagacccgagtccgcttcttcagcgtaatcttccgtccagacaagagaggcatccatttccttactgggtcgacggatctgatcccgccaccactcatgacggccctcgaaggcgtgtttccagagaaggcggtcatggaagagaagcgcgcctttgttgacgagggcgtcgtgctggaggagtacttctgggggttgcaggaagacggcgtcagcatctgcaaggataactttttcgaaaggggaagctagcgccgcgaaaggttttatggcccagccgcccgtttggagtttgagggttgtgtcgtcgaagacggtgaggatgttgaggaaggtgatggcggggccagaggctgccagtgttgaaaggtggttccggttggtcggggagaggtcgtcatcgcctgcgtagacaacttggatgggcagagtagagttgaggacgaagcggagagaggcaatgaggtgggcggcataacggagggtgtagtcgctggtggggatgacgatgccggctgagttgggctcaaaagaagcgcgaaggtcttgtactgggtgatgggaggatctagaatggtgcgactgaggctgcttgggaggttgcaggaaagggtattgtgcgatggcgactccttcaatggcgttgtgtaagatggacttggtggtagagtcctgtgaggcttcagcttgaatgagccagtcgcgaagaactcggttgcggcggcctagctcgccgaacttctctttaaagggtttctgaatagggtggtccgcaaagtattgcgatatatcggtgatgagggtggtatctattgtgatggttccagctgaagatgaatgagttgccggcttctgtccctgcccgaatccgaagacttgactcgttgacgatgcgggtggaagcagcatgaatatagagagcgcaaatatgactgcgacggcagcgaagatgatccggaagccgcggtggctccggatcgccgcgaactggctcatattgtgcgagaagagcttcctggactcatcccaagtcattgtgcaacaaagaatttggttgagcaagcataggtagtccgtgagaatagggcgagcaagtcccgtgcagaggattgcttctgcctgcacggatgacgttggcagcgggcaaacatgcaaggccggaacctgatgggcctcgcgtcatgaccgggggcgatgacatgtttttaagtggtatttagattaacaccttagcgactagaaggaacttttggccccggtgcatacgtggatcccagttcaggatcaagccgggcgcagctaaatgggggccggagaataagggggacacaagatcactgccaaaaacaaagaagcttgctactgacttgtcagccaagtgggtggacaatgggcctagtagggctgaaccccttgataggtcccctgagtttcgttgattttcgggtcggccaggcatggatcggagtccggccaggcagaaagatcctatcaagaagctaaagatgctttttcctggctaagcctctctgggtccaccgatttagtggagcttaaccaatggtttaatcttcattcgtcgactcgcagggctctttttgggtttcgattactcacgtgtttggctccccttaccatcttctcgtatgctggaggagatttctgctgatggttactcagacagatccagcgttccggaattctatgcgactaagcggtccattaatatagcgatttccgaccatttccgaagaatatgagttcagataagggggccttagagacatattctgtgtctaggctttcgtcagagtgaaagcaaactctgcaaacccggtcgggatgctggctaaaagggacaagaaggtttgtcaaagcacccccgcaccagttggcaactgtgaagaacagtagatagtcagtaagccccagactacacgaaaatttctgggcattatgctatttatggcaccggcttatcacaccattccactattacgagggtcaataatctctgccacagtggcttggcagatacgctgggattatcatgctcgggtacagttggacagtgcgcacgagaatggcgcagtcactcagcaacctgaaacaccatagcataagtgtcttggatgtccatgattagtaataggtgcaatgcaccaccctttatgcgtgcaggggtaacttcatagcagttaattaagcttgtggcagccagtgcaatataaactaatgtgatatataatcactgtatactttcctacaataacaagattacactgtagaattatatagattcgatgcttatacaatgagattgcctggcactgaagttctgtgaggtttctagaaattcaggcgctatagggcggattacattgggccggatgaggttgcagtgccagagaaatgttaagtctggttccagtatcagtgagtccgcataattgtcagacagcttcactcaatttcttctctacctgagcggtgttccatgggtcagttcatgtcatatcgtctagtggcacgtcatgacttcactaatggctggctccgcgggcatatattccacctcaatggaaaagagactttccattcggctacacgatagaaattttacgtgacttcataccacaacatagcagtctatgatgctctagatgccgtcactggtgaagtcacagtgcatattccaatcgtccatattaacccttaaacaagaccagttgatctaaacttgtggactagccgtagatctcacgtcctagccaactcccccgacccgatagtatcgacaatgctctcaactataacatctttcctcatccttctgttctttgttaccacagtctccgcctatcccttcgaggagaactcctttcctcgtctccaggatactttagccactggcaccaaacccggtgacccccccaaattcggtggtgggtatgactacgtcgtagtgggcggtggcacaaccgggctcctagtagccagtcggctagcaaaggcaggaaactcagtcgccgttatcgaaaacggcacataccctactgggaatttgactacagtgccagggtacaatgagcagtggtttagcagggtgttgccgtcgaattggacggatatggtgaatgtgtggcctactgtgcagcaggtggtatgttgcccagctctactcgggggtgaatacttacgggcgctaatcctggctttattgcagggagggggagagcagcagcatatgatggggagaatggtaggtagcttattcctctactttatcctgtagcctttgttatggttatgtctgatagaattgcagatcggagggagccagggctttacctttgtcgattacttccgcactactaagggggctatgaaaagatgggctgacgaaactggcgatgattcctggacttgggagaatgtccagcaatactataaaaagtcattcaaattcacaccaccgaacaataccgcaagaccatcgaatgccacaccggactatgagtcaagtcaaatcgttggttctacgcctgggccactagaactcaccttccccaaatatgcccaggcatttggtagctgggttaaacttggtctcaacgaattaaaagctggtatcaatcgagtctttgtcgagggcgatatcaaaggtgccagttggatcttaaatatgatcgattcgcaaacgggcaatcgcgccacaacatatacagctttcttggaaccaacacagaaagatgacacgtcgaagattgacgtgtatgtggagacgctggccgagagaactttgtcaaacactccccctggcagcgaccccgtaaccatcggagtcttagtgaaacggtggggcatgagatttccgatattcgcagggaaagaagtaatcctagctggaggacccatacttactcctcaatttctcatggtgtctggtatcggtcctcaggatcacctgcaggagatgaacattacagtcctagctaatagaccgggagtcggccagaactacaacgatcatattctcttcggcgtcaagcacgcagtacaagtggagacaacatcggtgctcctcaacgataccaggaagtggcaagagtgcgaaagattcaaagctcacgcaaatggcatgctggccgatccgggcccggatttcgccgcctttgtcgattacccggaagatattcgccaaaacctgtctgcccagactaaatcaggtaatttgtggccttgtgtctctcgtggttccgttgtgcctaataatatgattctagatctctcccaattcccctctgactggccagatatcggtatcgtatcttctccactcggcgtcaatggcgacggcaatcacaactatgcagacctcgtctgcatccctatgaagcccatatccaagggaactattaaactcagatctaagtccatggatgataagcctgtgctggatccgcaatggcttaaatctccgacagacatggatactgccgtcgccggtctgcagtaccttctgcgcctctatggaacgaacagcatgaagcccatcttaaatgcctcgggtaaacctatcgatctagaaagttctaacaaggacgacctcattaagtatgtgaaaaacaactatcgaacgttgaatcaccaatctgcatcgtgccgaatgggaaagcgagacgatcctatggccgtggtggatagtaagggcaaggtaatcggagttgatagatgtgagtcctacctacttcgactctggacttgacgtttggttgctcctccgtgttgtacgtacggaactgattgagaaacagtgagaattgctgacccgtccgcctggcctttcttgccagcgggatttccgttaggcactgcctgtgagtaataccctaccattcccacagtcagttttggaatgatcggtctaacctactcaaactgtagatatgtttgcggagaagatagccgataacatcctcagtgatcatggaagtgacaaggatgaggatgaggatgagctgcgagtggaactctagagagagggccctacgtttctcaacggaatgatgaagagtactcattcgaacatgaaaaggcaacgacctactgtaattgcaacagaagtttttaatactgtctcagataatgttaatctactagatcgcactacaggaaaaatgactgcaattggcttgagcgacaatgatccgtttctgaaggactcccaatggcactctcgaacgggccattaatcccaacgaagggagcaagaagaaggtcagagcgaaggctactgagatctgaatatggaaataacatataaattgattaaaagtataattctaatgtagatgttccgttgttgattattttggcatcgagcatattcccgccaggggtaatttagtatcagccacgctatctaatcggtacacgccagtgacatcaaagtacttgccggcgaccgggcatacacaaatcgaatcaaagcctatactagtactctgcagccggcatctactatttccgataaaatcaacgaatctgtttgccagattccaggtaagcaatgattggcatcactttatctgctcccacacactcccgccacatgtctggcctgaagagaagatcattgtcgaaatcgtctctcggaggctaaatatcgaattgccccaccttcccctcatctggtgcagaaagcgaacgtcgttcatgatggttttcacatcaatcctcttaaatcaaatcaggaatcatttttcctcccatggaaaatgccatccaccctttgcaacagatgcaaagtcctatactttagcgccgagtccctatctcgatacggcttcacagaagtggaaacagaaaccggaaaaccccacctgcaattcccagctgggcaacattccatccctatcgaatttgactgtcgtgatgacctccccgaattaccggctcttagggcgtcaggcgaggcaggatgcttgttctgcccagcgctccgaaattcgctgctaaagggcattagcgaatgtcgtcttcgcagttgggtcttggggaatcatgaccatggacaatggacagtcaaggtggtcaaggtttcgctgatggcggaattcagagcctcggacgacgagagaagtaaattcgcagcaatcatgatgggatgggatgttcttaggccaggacaggatcggtatgagggcgattttactgggcccgatggtttgatttatttcaagctacgtgcacactatggtgggttatccgttttctctcttatgttaagattggaagttgctcctaactgggatgacaatgcgtgctaaacaatattaggtgacccccttgcacgctatctaggcatcgcatatccccatcctgatcaagataggctctccactgaaaacacaaagacgattcgtcaccacttaattgaatgcgacaagaaccataatcatgcctccaacattgtccgccctggggattcaatatccgacaggttgcctctacggcttattgagattactgacagccaggaaggcaagaagctgcgcttgatagagacaaaagaaatcaacggtcatgaatcaacctgtcaagacgcctccaaatgcccgaaatacgccacactcagctaccgctggggctccgacgagttccttaccacaacccccagcaaccttcaagcgcatcaccgggatatcccactatcaccattctcggcagatgaccccacgacgaccctaccaccgggtttcagagacgtcgtcgacgtatgctgcgcgttgggaattccgtatctgtggatcgatagtctctgcattgtccagaaagaaacgagaaccacagacaagcctcttcttgagatccaacaggagcagtcccgacgcgattgggcctcagagtcgaccaaaatgcacagcatctacatgtcatcatacctgacaatttacttgactgccacagatacgcctcttcagaaagtctttgatcgaccagtatgcagctctgagtctctggtccccatcacatactccatcgaaaatcgccctgaagtccacggttcatacttcatcgagccctcgccttacacaggcgaactggatcaccttttctggaatccatacctagccgctgaggatgagctagactcatcagtatggaacacccgcggttggaccctacaggaacgactcctatccccacgaaagctctaccttggggtaaccgatatgctcggcctaggcttattgacctgcccctcaccaaaagattacgggcgcgatgtcgagctaatcaaacggccccgacgtcacaagtcactggacaaactggagatcggaggaacgtcatctgcgaccggggaacaagctcccgataacacaaaactatatcgcgcttggtataaaatcgtggaagactatacctgtcgtgatctgacggtcccaagcgacaagttacctgctgttgccggcatcgcacgcacacacgccttagccctgaatgacgaatacctcgttggaatatgggttcatgatttggccacgggacttctttggggcacccgtaatgcaatgagacctggcatggatcgatactttggagaacgagaacgacagcccatgatcccgacagaacattatcgggcgccgacttggtcatggtgtgccaacgatggggcggttgaatttcttgtacgtcatctccataatccgaaatcggagatcgaggttctcggtcacgatgtgatcccgcagtacatgggagacagctatggacaactggcagtcgaccaaggagatcggggatatgtgaagctcagggcgaagattagagtagcccggatggaagccaggttccagccgataccagacatcatgctgcggaacttccctgcactggcaaaccgaggtcccgaggctgagaataaggaatttcagttacgatatgtccatgtgactgacgatgctggagaacgcgggagtgagactatatttccggatcatgctggatgctatcctaacgaagaagaagtctacttgatgattgtatccaggggtgatcagcgggtgtggtcggagcctggtaagtacgaagttggggttcgatctgccgggttggtgttgttgaagtgtccgaatcagacgagattgcagtttaagcggattggcttctttacgcatttctgggattctggccttaccccagttttcgatgggtgtgagccgcagactgtttatctggtgtgatcatggcagcccttgaggtattttatagatgaaacagtaagactagaatctttcatgtaagaatgatttgactgtgtttcagcagtatcttacaggcacctacttgctcaatcattacctaggagaaacctataccttatgccctttgttggtgagccatacatgaccgaagctttgactagtatacataatccccagctcgcataaaaataacgtaaccgataattcgaaaatcaaagtagaatagcctcgagggagggcccttcatgttttcatccggctacctcagcatatagacaggtactccgatgcatctgcaaagctaccatccgagctggcggcactgctgcgctcttgaagcatatcctccagtcgtgagttaactcgggaaggaaaacaggagaagaagccagcttccataagactgtctgaggactgatcagcaatgagcttatatacaatcgccttcagctcattcagcttggcattcgcctgcttcaagagatgtggattggaggatattctcttctctaggaaggtctgtcgctttttcaccacgaaggcaaattccaggaggagcactcctaggtcagcaacctcattgtggacggcgtgcagccaagcagccgaccacgcaggcacttgtataaagttcgtagttccgacaacttagaacagacttgagcggctaatgttgcgatcgcaataacgctggaactgatcgatatggatccatggttggcagccgatcgaggcacaaacagcaagtaagaaattctctgaggggtcatcagattgggtgcgatgactctaacagtgatagagaacaaaaatactgtttatctgatgttgactagtaacggagttcattaatcccggtttagcaaattgggctcgaacccgaacttagccggtctcacaacggctcgacaatccaaccgtcaactgcagtcgggtaacattaagtaaagtggatgtaccactcacactagctgagtttgggttgctaagccatttgtatcacgagcaccaagagtgtgcattttcctggtggattctgctcgacggagaggctgtggtgacagattgctgtagccgtcctgagcccacttatcgtcctccgttcttttcatatcacactctgagaagcctaagtggtagcatttcctggttacaagcattcatcgcaatatttatttggggaagaattgcccacttctaggtttatttcggattaagcttcagtaaaaagcggatacttgcgccattctcgtacttattccttgtaagagccttggctaccatggccaccccagcctagatctcccatctgccagccttcaggtcgactgcgggtggtgggttaatcccgtaaataccgccacgatcgaatattctcctcggtacctggctctgtaacagttcaggaatcccactatcacggggatgattccgtagggtgtattctcactcggtttcctccgaaatcagaacatcaacatatctgaaattactgatttcaacctttcatgaagcgacgggcaaagatatgtaaacattcgcgaagacaccaagtagtaagctggtccaaaacgccaagggaagccatgtagcacaagactttggacttcagagagcatgctggttcatttgctttgactttctttcttcccctttcttacaaatttttgtctcccacccctagccgcccgtactttggtctacccctcgctcgagagactcccgtacgatatatagcatctcacacaccccctccctccctttagctgtcgttgcacctagaatcacaacatgagatttggccgagatcttcaccttcatcagtcctcggagtgggtggagcatcatgttccatacaatcgtctcaaaaacctgctgaaaattgccgttgagagagctacaaatgagcaaactcgtcccgatttttcaggtccgtcacttggaacacaaacatttgataattccatgtgcttaactttctttagatgtagaatcatgcctggatcaaagcatcgcagttcatcttcggtttcgcgaaaagcaagataactatcttcgccagcaagtagaaaagacaaaataccattaccacataagctctcgcgtttccgatccaacttcgatgtgcacactttcccaaattgacgtcgagattctttgcgaattgtttagcaagttttcccaggaagcttttcaactgctgcggtaccaacggttggatgttgaagccgtttctcgcatctacgcaaagatcgacaaacatctagaaggggagaaatgccactccgctcgaccaaactatctggacaaattcatgagacaaacactagcgagcgtaggtatggcggggaaattggacctaacggttgcccgtgtacaggagagacggtcggatcccagcaggccggcctacccacaaccccgattatatgaggcgctacggcaggatcatccttcgacagttgcttacatggtagaagagtccttacaacagagtaacttaccaagggagttatttctctctcatcttctagagctagcagtatatgaacttcgccctaatactgtccgcacattactattcgatgtgctgcctcagaacgacattgccatccaggctgtattattgaatcgcttgttcatggttctgggtcttcggaaggggcaactatcagcaccgtattcctgcacactcttctgtaaaatccgagaccttctctgccaggtgattggggagttagggcccaggtcagaggaggttctgctgtcggaagatgaactcgggcgcctccctctacactatgctgcttcagccgggcttttatgggtgtgtatggcaatattcaatgtcgctaaaagctggaatactacatctagatggtgtttgattatgcacactgacaaacgagactgttcacctctcgagtatgcggttgttggcaaccaccgcgacgctgtttcatctgttctggtctacctggaaagattattagacgcaccctatagtgatgacggaataggatcattgttgagtcgcatgctctttattgcgcttcattacggatatgagggtctgatttcgatcatttcgcggacttgctctcgcttctgtcagagacccaggacctgtgaaggggccagcccgctgcatgtcgccgcgcgtactggaagggcggatcatgtacgactactgttggggaacatatgcatctctgatgtgagctcggtggagccgatgtacggttggactgcgctgatagtcgcctgtgtcgaaggtcaccagagtgtcgtcgatgtgcttctcgagcatggagccgaacgggaccacagggaccatcgcggctggacagcacaggagcatgccgcttttcgggggcatcttgccttagcgaaagcaattgccgggccatccaagtgggaggcaggtaccgatagactacctgccgcaccgttgacgcagcagggtgccaagattaaggctctacaccaacggtcgcaactggtggtctaccttggcagcctgcaggagggaaaacaatttaaacacatagagcttcgaacaccatcactgagaagtaaagcctcggactacaaccttgcgctcaaagtttcttccccttggaatcactctgttcgtcagctcaatttgtccttgcttagtgacacggccaacgaaccaatgatctttgagcttcccactccgaccgaggcagaactgtgcctagagctcctcgatttgagcgatggtcctaaatgtcaagcacagttgcttggaggcggtacggcgctgctgatggacaacctcagtacctttggcgagaaccgggaaagtctggtgcgcgagagaactgttcccattctcatgagcgggtcgttccaggttatagctactgtgaccttcacatttcttattatcaagccatttcagcatcccagcatcccctctgtgagagaatgctttctccgttttggcgatttctgtctcgtagggcatcgaggtaagcatgcaggttgatgtgatttgcgctcgccgctgaaaatctgcaggtttcgggcagaatgttgccgggcatgattacttacagttgggagagaacacagtggaggtaagtggtagtttatctaactagaccatatgctcatagtgcccagtcattcctatcagctgccagtcagggagcttcttttgtcgaggtaatgttgaactcccctgttctatcttgctgatctaacgtcttctagttcggtatgccattcgctattgaaatcttgtttttaccatgtactaagctgttgcagatgctcaattgaccagagaccttgtacctgttgcataccacgacttttccttgagcgagtctgggactgacatcccagtgcatgatgtgactctagaccaggttagcagtattacctctacgacctacttagaatccatctaactttccagtttctgcacgcgagcaaaatacaatcctcaatggggcatccaaccttcatcttgggaaacaggcactaccatcgaaatcgacgctcgcggtctctcaccagggactatgaccacggcgcgcaacaaatgcaagagagaatgagacacacggtagactacatgaacaaaggcttcaagcccaacacgcgaggccacattgtccaggacttatttgcaaccatcgaagagctactaatccagctaccggaaaacctcggcttcaacgtcgagatcagtgagtcgtccccgtatctcatctcagaaaacatcgctaacaattactaagaatacccccgacttcacgaagccaccgaggcaggagtagccccggtagcgatcgagatcaacacattcgtggacaagatactggaaaaaaaattcaccttgagtcacagcagaaacatcatcctgtcctcgttcactcccgagatctgcattctcttggcacacaaacagcagacctatccagtcatgtacatcaccaacgccggcaaggccccagtcctagacagagagaagcgagctggtagcctgcaagctgcagtgcgatttgcccggcagtggggtctcgatgggattgttctcgcctccgagacattgatcatatgccctcgtctgatcggatacgtccagcggtcggggctcctgtgtggctcgtatggaccactcaataatgtcccggaaaatgcccaggtgagtgatgtcgcccggggagtcactcggaaatatactaaccccaccttcgtagctccaattcgatgccggcatcaatattctgatggccgaccgggtcgggcttattgccacagcactgcagggccgggatggcgatgatcggcgattgaagaactagcgggttgctccgaccggtcgcataggaagtggtgacatagattatcaatgagttagggaagccctcatccctcgataacgaatctacatatcgtatcttttgcatactctctttgcctatcttaaatctttccatagggtcttaagcagtgtgggaaatgcccactctggaaattcggcgtttcggaccgcggcggatgcgggtggagagagcccgaacggcgccgtcgatcgtcagcgataaggtggtgatcccaggggtgaagtcatagtgtggaaaacctttaaccagtagcatgattttagtaatttgtgccagtcagtaagaagggcaaatccggatagcttcagaatgggcagactacccagtgtacgtgggcttgtcgaggaaaaagacgagccccagataagacgtaaaagcctagcctaggccgatctcgtgggagggacaaaggcagcttgaaccctgaaaaggtgaggctccactggttcgcccatgcgatcatccgtgggtctccctcgttgcgctgccatgaagccatttccctatggcgtcaccagccgggccttcgccagggttcctttgacttcatctgtccacactctctttgcacacctgtgttttctttgctgtggctgtcctatccttccgcaatcattcagttcctcttccattgttcctgaatacatacacgaaagtaccaaattttctcattggccgcacatggtcgaaccttcctatctctgctagcagagatgccgcaccaagatggcccaacggccgacgactggccggacgagcacctcaccgaacaaaccaccaacagcaccggccatgggcggactccccggcgtgcgcattaccatgagaggggactcaacaccggggtccgggtaatgggtgcgtgcattccctaatctttcttcatcccaagattccctcattctcaactactaaccataatcgatcccaccagatgatggccgcctggacattaagatccgcgaacgcaaaccctgggtatcaaaaatcatcaaacatctccaacagcaaccagaacccctccatgaagagcgcaagccatctgtctgctttatcgaagatgggaaacccccctgcgccttaaaactcaacatcgtcatccaagtcgtcggctcccgcggtgacgtccagcccttcattgccctaggcaaggtcctcaagtcccacggccatcgcgtccgtctcgccacacatctcgcctttcgtgaatccatcgagcatgagggtctcgagttctttaatatcggcggcgatccagccgagttgatggcgttcatggtgcggaatccgggcctgatgccgcatatgagtaccctgcgtagcggggcgattcctcgccggaggcgcgaaatgaaggctatattttcggggtgttggcgctcgtgctatgagacgggtgatggaacaggattgcatcatattccggaggatccgtggagtgagacggcggattatcgcacgatgccgtttgtggccaatgctattatcgcgaatccgccgagttttgttcatttgagctgtgcggagaagttggggattccgttgaatatgatgtttacgtgtgtatccccttttcagatctagatgatcgaatgtgctgatcaaatgggtgtatgcagaatgccctggtcggcaacacagtctttccctcacccgctggcaacgatccgcacaaagaacaccaaaccctccgctgcgaattttgcttcgtatgccattgtcgaaatccttatgtgggagggcctgggcgatctgattaactcttttcggaagcgtgagctcgggctggacccgttagacgctattcgggcaccgagtattgcgcaccggttgcgtatcccatacacttatctctggtcgccagccctcctgcccaaacccggagactggggcgataatatagacatcgccggcttctccttcctctcctcgggctcggactacacaccccccgacgacctggcgaatttcatcaaatctggacctcccccaatctacgtcgggttcggctccatcgtcgtagacaacccgggttcactaacaaagatcgtctttcaagccatccgcgaaagcggacaacgagcaatcgtctccaaaggatggggaaacctcggagccgacgaagacgatatcccagagaacatcttcatgatcagtaaaagcccacatgactggctcttccagcacgtctcctgcgtcattcaccacggcggagcgggcaccaccgctgccggactggtactgggccgtccgaccatcatcatcccgtttttcggcgatcagccgttctggggctcgatcgtggctcgcgctggcgctggcccgctgcctattccacataagcagctgacggtggaaaagctgacgaatgcgatcaagcaagcgcttgagcctgagacgttggagaaggcaaaagaaattgggaaggagatgcgtaaggagcggggggtgcagaatgccgctgctagcttttatcagcatctagatgtgcagactatgcggtgctctatttgtccggatcggccggctgtgtggtgggtgaagcattcgcatattaagttgagtacgtttgctgcggcggtgttggtggagacagggttaattagtccgcggaacgttgttctgtatgttctgtgtagtttgtatcttgcggacggtgtgtatatggctaactggtggttttagatatcgttcacacgaatacgacacgaatcgagatcccagaggcccattgacagccggtgcggaggttctctacggcatagtctcggggttcgccagtggcatcgcggaggtccccagcggaatgagaggcatattctcgacgacgcatgagcgacgactgcatcacaagcacgactggaaaaaagcgcgtcggccatcctgtcttgatgaattgaatacccctcgtcaccgtcatcggcgaacggaaacgtcccttgattctggtgtcggggctgatgtggtgccaaatggtgacagtcagcacccaggaactggaagccaaggccagtatgagcacggtgatccccgcgaggacctatcctccaacgaggactcccgagaatcgactgaatccgacgaagcgtatcactccgctggggaggagattcaccgagatcaggccgtttccgaccgtcagcaaaatgtaaacggggctaccaacagccccagcagtggtgatccatcaagcccgcccataagcagctccgatactgatacgttcgacacaacggatgacgatatgggcgcggagctcgatctcgagcgaaccgtaactcgactgcgatcgagggaaatgtcccatacaaaggaaatattggcagagacgtcctatcacagtgccagggcgacaaagcatattctaaattggctccttctgttgcctaccgatttgactttgagtctgacgaaagggtttcataatgccccgaaattgtatcacgataccctggtggaagaatcgccacgagtgcttggagtgaggagtgggtttcgtgctgcaggaacggtatgctcttcggatgcccctgaggaatggttgaatttgctgatgagtataggaattcactcatggattttacaatggcattactggacttgtcacgcagcccgtggtcgggatggaaaaggctggtgggaaaggattattgaaaggtattggtaaaggcgtaggaggtgtcttcctcaaacccactgctggtgagtttctcctcgacaagactggcaatgtcagagctaactgggacctgcttaggcctttggggtttggcgggctacccgctggacgggatgcacaagagtctccgcaactcgctctccaagagcaaaacgaaagatatcctgacatcgcgaataagacagggtattgaggagatgtgtgcagctaccacgcagcaacgatccctggtgatccagaaatggcatgagttgcagccaacggggctgaggcatgagcatgggcatgaacatggctcgtaggtagatatacccagtttactgtgttttttctgcatgtgtacgatgtatatttagtctgtagtgtatagctttgtggatcgaatgtacactaggtgtccataactgataatgattcttgccgcatgtgattgataagataggagaatttcggatcatccctgtgcagcaaggcttgtttctttccttttcagaagacagaattcaagagatttatcgggatcactagccacagtgatgtcagcctgttattcgcatctcgattgcccgttcaggaattcactggtgtccatctctcaggccttccaaggcagtcattcactcagctcagccacttccccccacctgaaccgctccttcgtgaactctgggccccggatcagcccaatcaaaccattcacttggtcccttagtggctgtgctgtcgctcttcatttccgtcctgtggctgcgcccgtctctgagcttcagctgtcagatacttaaacgtcgcacaaccccacttcctcgatctcacttcatcgtcatcatcaaacacagatttcgtccttaatctgcattcttctgaaagaagaaccatgtcttatcagcaaccttacggacagggtccgccacagggctataatcaatatccccctgcaggacagtacccgccgccgcagggacagtatggccaacaccaacaatatccacaatatcccccgcagggtccaggcccctaccagcaaggtccaggttctcatcagccgcctcaacagcacggttcatacccacctccaatggccggtcatcatcctcagcagacacaggcaccataccctccacagcagcaacacccaccacagggtgcctctccatatccacctcccatgagtggccaacatcctcagcaacctggtccctattcttcatacccaccatcacagcagggcatgggatatccgcaccagggccctccatcccagcagggctacccacaagggcatcctgctcagcagggctatccgaatccgccacaacagcaataccaatccttcccaccgggtcctccaggccaacaaccaccaccaatgatggcacccccaggagcaggcgggccttaccccagctataacccccaacaaggcccaatgccctcccgtccctcccccggctatgatcctactttccttgccccaggcacagcatccaacgaagccgaggttctccgcaaagccatgaaggggttcggcacggacgagaaagcgctgattcgcgtcctgactagcaccacagacccgaaccggatggctcttatccgccacacgtacgagaggatgcacaacagatctctaacaaaggacctgaagtccgagacctcgggatctttcgagacgatcctcgtttcgcttgccacgggcccattggaatcggatattacgtacctccacgacgcgatgagtgggctaggcacaaacgaaacgggattaaacgatgttcttctggggcggagtaacgccgacctggctgctatccagcgcgcctaccgcgacaaataccacaagtcgcttctcgacgacatcaagggagagttgagcggcaagacggagcggttcttcgagatgctactcaacgcgagacgacctgaacggggaactcccttcgatccccgcggtgtcgagactgacgtccgagaactgcatcgtgtgaccgctggaaaagtgggaacagacgaggtcgctgttttcggtatcttcatgaactcgtcggatgagaggttgaatgtgctggctggggagtttgagagaatgtatcatgtttctctggagaaggtcatccggggtgagttttcggggcatttggaggatgcgctggttacgatgctgcgggtagcgagggatccggtctccttccatggtgcaactttgaaggagtgtttctctgggtccgatggggtcaatgagaagaggctgatttattggactgtcaggttgcattggaatccggagtatttcgcgagggtgaagggaacaatgggagggaatttgcgcgcgttggtgaagaattatgtttcgggcggggattttgaagatgcaatgatggccgtttgctctcattgataatatttttttgctttattttctgctgtattcttcatggtggcttccataatagtaatgatagtatgatgatgaaggattgtttttcgaggtgttggtgtgtcattcagtagtactagtactagtaggcttggctccagccatagtgaccaactactggcaatatatatccggcacgagttgtacaaaaatcgtcggccgagagagagaaaaccggacacaccacgatctcacaatgggaagcagtgtaagagctctatgaatcaattagatacatgaccttcttaaagaacaacaagatctccagagatccaacaaaccataaatgcaacggacacaaccgctatgctggagctagcatgttatggtgatgatctatgttaaggcccttatgtattaaagttgtgaccaactaccataacaacggcaaggtggccgagcggtccaaggcgccaggttaaggttcaccttaacagtcagcttccgagcttcctggtcatcgtaagatggcgtgggttcgaatcccacccttgtcacttctttttgtctttttgctattctcacctggttgcttgcttactattttttccttcttccctgttccgagtttttgggcctgtggccgcttggtctgttctattgcatctactcaccacgctggctgtctgccgcccgcctgccctctatcagctccaccatttctttcacggcatcatcgcgtcgtaatcgtggaacatgccgatttgttggatcctttttgtcgacagagatataatcaggtactaattcaatacgagcccacgtctataaagaacaccgtctccctgtagtttagttagccagggcttccttatgcttatgaggtccttagttcgtttcctcaacaacaacttctgttcgtccctgtttctacattcaatactatctcaatttccatcttcatgcattcacctcatatagcaaacctccttgtatataatcaaatcgatggaacagcccagtaagctccatccctacattgtatcagagccatcgccaccccacacatctatccagaacaacttatagtccggtcttcccacaaaccaatggaccagggtagcactactgagttattctgttgttgtatacaatgtttgaaataatgacgcaggcaccggaaacaaccctccgagcctgacgtccacgtggcgcatcgttactatttccatccccgagtcaggatagtgtcccctggttgagcatggaaataatccaatcgccgtccatctatatacttcagccttaaacttttacaggagatagtattcgtcttatcgtgccgtgttatattacacctcagtaacaatggtattgtcgatccaacaaagcgtctttctctacatgccattatactgaagctctttgttcgatatttccctgaagtgcttcatcgtgtctattgtactcggcttgatccgggaaatttgcccatccaaccggaaacatgcgaaagctgagacactcttcgcttcatgaagtgaacaggactataaaaacccagctgcagcagcaacatgtcccgtaagactcgagacgcacacatacggaccgccgcgcccctttgggcgctatccacggtccagggccccgacgtgttgtatactgtgaatcatctcaaagcgattaatttagtatatgacgagattctagcatcttcaggactgtcgaagagatctaagcctgcgggatctaagtcgctcgcatacctactttgagagtttgcggcagggaaaacgcacgactgaagagttggtcattaagagaacgaggatatatgacttgcttgggaatgaagatccgagcccgacagaggcaatctatcgcacggatcattggttaagaggtcggaacatggatcgagaggagttcttgaaggtgttctggggtatgtgtttgtttttgagcgattatacaagggttgtgtgatgggattgtttctgtctactttctggggtttatcttgggttaactgttatgtatggtgttctgttgtgttatgtctctctggagtttgtttcaccatatgctgagcgatttctgtcctgtcctgtttggagtcactttgtttgctaagttgattggttgattatcggagtgagaagtcaaaaccactccggatcgaagtgagtcgtcaatatcacttcctactaataccgatcattgattgatccgtggatttaattaaaacgttctattgctcaacgaagacctaattgctggttacatcaacatccacccaacaactagatctcttctcccccccccgatcgatatagattcgacttagatcaagccaatcctcgaatcacagtaaatcatggaataatttactgagacgcaacgcactggtagtagtaagggttccacttcttgcaaacggagccgctctcgcacgtagtagggccagtgtggttgataccaccgcagcgctcgtacatcttagcaacaccgccagcggaagcgctagcgctggcactgacagcagggacgacgctggaagtaggggcgggggcaacgacggcctcagtgctggaagcagcaaccttggacttggacttggtcttgttcttgcaggcagtcttggaggacttagaagaggtggcgaaggtggtgggggcctgggcctggctggtgacagcggaggtggcctgctggacgggggcagcagagctgacgacgggagcggcagcttcggtggtagcagcggcggcggaagaggtggactcaacgacagcagcagcggaggaagagacctcgacggcagcctgggtggcgggggtagtagcagcgacagcagcggaggtggtagcagcagcagcagcggaggaagatccggagctggagccggagctggagccatcccagacatccgggccggggatggggtagctgtcgaaggagttgtagatatcgaagaggataccggggtcagtggcggtgtagacgccggggatggagacaccggagggaagctcgctggagccgtcggaggtgaccttgaactggacacactccatgtagaactgggcaccaccctcgcggttaccctcgtggagggcaatgatctcagggcggaagaggtagttaccggcgggaacgtcgggaacagtgatgttgtgcttgcccttgttggcgatcaggatgtcggtggcccactcgtcggagctcttgtggtatccgtcctcggcgatcttgacccagttgttgccgttggagcccttggccgtcggggccatgtagacctggacgggacccttgtgggaggaggcgatgatgtcgtcggagtcggagcggtcgctgtggtgccactcgaaggtgacaacgtcaccggctttgacggagagggtcttagaggcggcctggtcaccgttgacgttgcaggtcatgtcggtggacgtgacgtcggtgacggggctgttgctggggggactgcggatgtagccatcggcggagttaccgagaccctggtcctcgccgttgatccagacggcctggacggtggtgtgggcggaagccagcttggaagccgctgccagagcgagcaaactgtaggtggtagtcttcatggtggtaagtgaaatgaaggtgtttttaagttagggttaaagaatgaatgtgtggtaagaaggaagagaacgtagttcgcagagaagaaagtaagaaaaaagaatgtacagctatcctggctgatgaaaagaatgcttgatggaaatattggaaggcaggttcgcagagagtgttttatatcagggctcgggcaggggaatgggtaatggaatgccggttgagcggcggaggagatgcgggccctgccaagccagacgtttcatcttaatgcgatccggccgcgatccatgctccacagaacagggtcaactggaccctggcggagtgcattgccataccatccgccggttgccaagggcggctgctacagcggcgccttggcttcattttgcaggcgcgtagagggagagacacgggtcatggccctcttcttggcctggctagtcttactctcagacacttcccatagtgtgatagtcagaccattagctggctaaacggccaatcggggcaaatccccggcgtttagccttaagcatgccggaccttaatcttgttgtggccttggcttcttgctgcaaaagctttctgtcagcttcgaaggtggggacattcgccctgacggtgtccctggttccaatagcttaccctttatcctgagaattgttgtatgttaacccctggtcaatcagcaatttagccaaggaattgtccaatctctgtgtgcgctcagagggtgttctcaaggatcctgttcatgaaacggtagtgttagtgaaccaaaatcagtgatttattacggatttgccggtgatgagtttcaggtctccggtcgatagcatgctgcagaaccaatcccagccaatccgggtaaactgataataatacttgactcgcatatgggtcagacagcagacagcctcggcattgtgtacacaataagtagtagagcaaatcgttcccatgatggggagatctttaatcaaagttaatctacgatcatgtacaataagggacggctggcacaatacagacggcctatggttggaaaagtgcggtctatcatctgaagtagttcagttccggtagaatatggtcccttttatccggcagcagctattctatgccattagtaagctcgtattcagatgaggtttctgagggctaaagactggttttcatactggctatctaagaacatatatatttgtaataatattgaatactgtgagtatcggacacttcaaaacaatctcgaatatagagccttatagcaattgcgcctttgtttctctatttacaaagaaattagattgtttttgtgtgtaaatatccgcttataacctcactaacagtagcgcacaggcctgaccagatatacgagaaccaggatattgtataatattcagcaaattaaggaaacatatttcatccaatcagctcctatggctcagttggtagagcgcatgactagtaatcatgaggtccgcggttcgaatccgcgtgggagcatttctttttctttttgccgtttcagatccacatccttccatctatgtccacacagcaccggtgtgatagatcagcaacaaatgtatgattttgtcctcgactgtcaactcttacggcggatgtttcaaataattctgttaccgcataaaaccccgcacatgagtgaagaccgagaaggcaatgcccaaaagcaatcacactatccacacgttgattatagataactgttatatatgatcgctagctgacgcgcccgtaatttgttcagatctgaaattaaggaaattttgtctgtgcttatttatatcttctcttatccgattagaacgtccacaacgcgtgttactggcaagatgtactgataggctacaagcccatatgagaacagaggagagattatctcacagtctacctacagcaatgaactaagtaaaggcttccgacccacaaccctcatcaacttgagtggcggggaatttccctgtgcgcacagacgccgatgctgctcaaccagtttctctgcctcttgtgatgcgaccagcgcggtatcgacctgcttagatctcagcaaaagaaaggcatagagtgttctaattatcgcagtgagtctctcctcgatctcatagcgcagatcagggttctggtgagagttataacacagccgctctacacctacaaacccagctgctcggctctcttcataaaccttggctgaagcctgaaagcatttgccttcggctgccagtccatagtcaaaacagcgatgaagctcactgagcactggttaaccttccgtgaggtaggtttcttcgtcaatttcctcccactggagatagccaccgggctctgcggtcatattagtaccaactcgtgaggcagcaatgcgatgtgcacaggaaagggtttgccatactcaatatatcatagatatttgcgatcgcagctttgtagtcagcttcctcaagggcagcgactagaagacgaacgtgtaccaagtcataacgttcccgatgttctcgaggaaatggaatcgtcagatcttgaacagaaaactggatcgctcctggattctcaggaaattgctcggctgaaatatcgaagccatgatagtagcgttcaatttgtggtgtgtccagaaatttcgacacatcttgcagccaaattctgacagaaaaattgcccatcagctccaatgacccggtcttgcacggaggggacagactcacccagttccagtagctatgtctgcaacagatcgaatttcgttgagagggattgaaggatgaatgagggtatctccgcttgttttgactagcacgcgatgctgtaagtccagtctagactggcattagaaaactgtacgagatagttcataagcattgaaatatctaagatcatacctctccgattctttcttatccctctcgaagcaatatttgtcttgagtagccattgttgcgtttcgctggcgtttgttctccctcagatgggataagggcgttctaccctccttaaatactatagaacccccttacttgatttcactcacgatctcgatcgttacccggcggtagttctctcaccaatcagcatacttcgcttagagtatacctttaggtggctattggttcttgtttgtcgctgaggactattcagctccaccgactcgtggagtagctgcaggagctgaagaattgccacattccgcacccctcagccagccacccccagaagcgcgcacaacaaagcgattggtgctgcgttgatgatctagacaacctgcttcgagactaaatgttctaaccgcgaagcgtgttcgctgttcatctcggctatattttcctcatgccctggcagaccgtcacaaaacgtgctgatctgtgctcgcgcctcttcatagccacgtatcacggagatgcccggcttatcaccaggccggctaagcttccttgaattagctgcctgtctgatgtggcgcgcacttgagaaatacctaagggctattttagcaacccccatatcctgcagcaacatggaccgagaatagtttctgctcagtcaacgactggtggcgtctgcacaggcccgtatacgaggttggctgagaagacttataatagaaggggaaagacagcactgtgagcaagatctcaatgacacccggcatctggtcaagctttccatttgccgctctcgggtgcctgaattgaccccgcctttcaatgtgatcgtctaccgtcgcgccatagtaggatgtttatgaccaagtagagggccccacaactttcactggcatcctagggactacgccttcgagttccattaggagcatcttttctcccccggaagcacccaacgacaaaagtttagaggacactaaatccactgaaatttggacttaaacccaagattgaatatatctcctatgactcgagagaggtaatttggtctctatctagtgtctcaagtatcctacatagataccctgatctacagttactagtcgctttgggatcctcccccatataaaagatatctatgtaaaggtaagtatgcgatagaaaggcaacaattagggattctaatcttgtaggcttccagcttatggtagccagaaatcagatcagacagcaaatatcttcccgtgtaggagacttctcagctccatgaggatctggccagtaatttaggatgatagtttggagttgggaaggcttagtgccaagctgttgtactatctcaatggctgctccagagttcaaagggctgtattaagtaaaatgattatagtattgttactaactattttcagtgggattcgactttcgcaccaacacaccttcgagtcgcctatagatgccttcataggaagagcgataaaacctgccatgagccagaagtccgaacgtagagaggtttggcctatattcactcgaggacgcaagtatactccggaaacccagagaaaaaattcttcgcagccgcctcactctcgtgcaacattccaacgtagccaactcgagagtacgtgcctctcccagtccgaattaaagccaagccagataacttccaaaactttctggccacatgaaaagcttcaattggcaggcagtagatctcggcgcgcatttcgctcttgacatcaaatataaccttgcacaaacctggcggatatttcaccgtagtcttatgaccttccacttcaagggcctcaaggctctgtacagacatggcagtgtcttccaaattcgaggcacttgaaatgagctttgcagacgcgatgggtcctttcaaggtgacagtgccactgctcacttgaccagtctcatcttctccgcaaggaatacattcagcgccgatgacaagtgctaaagagcaagcagctttcctctggacaatatctgtgtctggaaacttaacagcaccgtccacagaagcccacgaccaggaaggggcgcgatacaaaggaggtctgcgacagggttcaaagatcttccaagtcaaacagccgggtagattctgacgccaaagcccagcaagataaacgtctttgtcataaccaagattttcgaggcgcttcagaacatcctttgccaagccagaaatggccacaagcttgtccgagggagctgtaagttggcaagccgagaaaacattcatgtttgcgtaccactcttcgtagatccggtctctgggatcaatactgtaccttagccttggagcatcaagaagctgtttccagaagtggttatattggaagaccggctgtgataacgacgtttcgtcatgataccctccattagtatcgatattggctctgcgaggacgatcatcacgctcgtaagcattgttcggttgagtttcacagcaggtacattctctgcattcccagaaaacttgttcccgaccgaagtgcagaacacgtgggcataaaaggcgttcctgcaaaatccaacctcgctttggcagaggttcttgcccaaattttcgtggcaaaggccatcctttttctccgcgagacctgaatgacttaggatcactcgaatcatcgacacgtatgttgacgatgctaggggcaacttttgcagagtcgcgcgagaaaaaacagccaccagcatcgttgctagagcttaatgcagatatccccagaaaagcattcctgtaaacttgccctatagctgcggattctctttgccagtcctcagcagaatcctggagtatacagagacggtcaatccatatgtaacggattctcaaccgttcgataatggtgaaagcgtctctgaatgtttttggaaggacagagagttgctggtactctctgagactctggaatgtgtctttcaacaagatcaaattggggttagatggtgttgagccccagcagtggcttagagttatgtagcgctcctcgggctggatctgttgcctctcaacaacacggaacattttcttctcagaactgattgtatgtagctctaatagccggcttgggataaactttgcctcatcatgttggtaatcgcaagtcggatgtccttgaagacaccgattcagccaccgctcaattaacacccacgttgtctggtcgccagtagatgcccctatttcaaagttcaagttttcatccaggcctccaatcatgcaaagatgcaatcgcaaaatgtcagcgtcattgagcgatatactctatggagcaaagaaggcttgatctttggcacatacctttatgcggaatcatatcgtagacgtggtaaatctctccatagcacaccaccattttcacttaacgagggttcaatatgaccctgaatacagaagaatatccgacatccttcagttgcgtgttaaggggattttctatatctttcaatgacgcgaatttgcagcatacgacgcagccttgctcgatagatgccacaaaggattctctggtgaggtgatgtccaaacaaccatctttccggcccaaactggctaccttggtctcgagtagagtcagcaccggaaataaggaacggtcaatcctgtgggttgcaaggcatcccatttttagattcgtcgtctatctttagccgccttgttctttcagggtcccagataccctctagcccttctttgcagactttgtataacatgacttgaatacttcgttgcttctccaatgacccccttatgccgatgaaagacctcccacggtcgtcggctctggcttcccctcatcgggcgtttgtgcgggcttaccgaatcgggaaaagttgcatgcagcataaccgtagtgaaacttagtaccaatgactgctcccgaccagtatcatagggtggttatagttactaagaccattaagccgagtagagtgactcatattgaagctaggtatcgagagggttagtgaacttggccaaaatggcctcatttatttactattctgggtatcatgaatttgagaaggaataaattcaagtacccttatgaatgaggagacaaattgccgttaaagagacgaatctagttcgagacctgtcaagcacatctccactatgctcgggtataagaacagttaactccgtttttcggttgctgcccgcagcagtaagtattaatatccggcccaacaattcagggttggcctgcttgtttggtcgagatcatggtcaactttgttcataatggagatattatggtgtatgattttccacttagcgtagacctgagcaccatcatggtgcgtggaggtgtggatcactgtcatccggttacataaggcccggacttaggcgatatagcctttcatacctccgctgagatagacctgccctggatgacatgacatcaaccagtatttaccttgcaggaataactgaggatagcgagtatatagccatccatgggtataccttataaatctgttgtggagctctctcaatccaagcaagtcctcgccatcacgttgattgtccaccgatctcagtgccttgcaccacatctcacaatggcctccctcgagcaagccgcacaaacctcccccctcttccgccaccgtcaactggcccctgcagcggcagtacgcgtatctcccctatgccttggagccatgacattcggcggccgtcaagagtcacgttacggagattgtactcgtgaagatgccttttctatcctcgaccacttctatagccaaggaggcaacttcatcgacacagccagtgcctaccaagagggacaatcggagatcttggtcggcgaatggatggcatcacgcaacaaccgcgaccagatcgtgctcgcaaccaagtacacagccgcctacatgacacaccacaaagatgcgatccagtccaactatggcggcaacaatgccaagtccatgaaggtcagcgttgagcaatccctgcgtaagctccagacttcctacatcgatctcctctacgtgcactggtgggacttcaccacctccatcccggaacttatgcatgcgctgaacgacctcgtcgtggcggggaaagtcatttacctcggtatttcggatacccccgcctgggtggtgaccaaagcgaatcaatatgcccgggatcacggactgcgtccgttcgctatttaccagggaatgtggagcgccgcgatgcgggactttgagagggatattatccccatggccagggaagaagggatggcgttgtgcccatacggtgtgctgaatcagggtcggttccagacgcgagaggggttcgaggagcgggagaagcataaccccggtcgcaaatttattcccacgtcggagcatgataagaaggtttctgcggctcttgaagatattagcactgttaagggcgtcaagctgcttgatgtggctttggcctatgtgttgcagaagtctgtctacgtgttcccgattatcggttgcaggaagatcgatcatattaagggtagcattgcgagcttgaatgtgaccctcactgacgaagagatggagaaggttgatgctgcttacccatttgactttgggttccctcacactttcctgagtggctcgatgtttgatcattctactccgagaatggccgagaagccaggtgatgtctggctgaccaaggccatgggcaagtttgactgggttgagcaaaccaagccgattagaccggcttcttaaatgtgatgatagtaatgttatgaatggattacacaaatattggaatgccatatgcatcgtatcggcacggtgctagttaatataagttccactatagatgctctgaatctcaaacaaatccttattccattcccatagaaatgtaaagaaatagaaaacgtgctgatcgaaaagtacaaaggggagcctgacaaaaccaatatgacagcaacccacagtttccatgctaggcgagctgaactatcacacctatcctgaatgatactgctcataaggatgattgactgggtgctggctcatctggtacatgtgatattgatgatttttcccatagtttggtgcagatggcggaagcgaacgatagactggtaccgtacccattgcaggataagtctggacccggggaccccgtcttacttgagaacagcagcaagtggtaatggtccaggataccaaagaacacaaagacaagaccacactaaaccatataactgtaaatgcgcgagtgccccaggtcccagttatgttgtgtgatttcagctccgtggcaattatacccttcaagagaacaaaattgactgttgcgagtgccgcagctgacagcaggaataagaaagcaacactagagacaaggctgatgacaaaacaattaaatgccttgtttacgacgataagagctgcgaggagttggacggccgtgagaagagtagccaagacgtatgtaatttgcatccaggtcgaggtagttttatatgcacgcagtgagcgtcgaagggctgacgaaaggtcggtctccttcccttcctcgccggtagctttcagtacgttgaagtacgagccagcttgcggggacaggcaatccattgtcgtgtccctattatcggtttcacagtagcccattatgccgaccaggtaagtcttgttaaactggctctcatcccatgttgtaaccaatgcattcgaagtggaaatatttcggctgttctggacatcgagctggacgcgacaagtatattagcttgaatgaccgaaattgcaaatcatgcttgagccttacttggaaaaaattgagtctttcaagttcgtgacttcccatcttcgtacatgccaggccgatcacgataagacacaagagtgtcccgatattcagcaaacatgaggtggacacaagcagaactcggtgaaagttcgccatggctagtgaatgcgatggctgctatgctgtctgcaaaatagcatttgtttatcccctgagatgccctttgagcgatgagccatagcttataaactggtgaaaaccaaactgatggaacgaaaacctctcaatatgcttggtagcgagagacgaaatgaaatcctgctagtccccattattagcaaccctaaatatcttagccgtgacgaggttcaactcttgcttagacgtggctggaataacctattcagaataatttagggcaaaaaataggttaaaagtcaagccaaagtttaaacttccgagtgggtcagacccggataaaattgggtaagaggccgaaatacggatgcgaacttcctattcaggaaaaggtccagaactttcaccagcacccagcctttcacgttccggtccttggtagagatcttcgtgactccaccatcctataccaatatgaccgaggacgctccgcgctgagccacatggggcactggaacttttcaggcaccacatgcgccgaaaaaaatagtacaccggggggccctctccatcctgacttgagccacaattagtgaccaagaattgagttagaatgccagtctaatccttgcaccattggccgagacatatcgttacactaccaattatggggccaggccgatagttttggaactccttcatgcagaaccccacctgtaccctggcccagggatttgggttgaatgggtggtgcaagtaggcattgcaatgacaaaacaagcagctcctctctgggcggttagccctacccctattccctcgtatttaaggcacaggtgttcctctcgatctctgatttctctaacaaaatcgaagaatccgaagacatcccatctacatcatggcagactcagagaaggtgtaccgagctcaccccagagacctaccaacctatgatcaagccacctcagaagagcttcgcaggatcacccagaacactagctggaactattctctctttgactgttgttcaccaggcacattatgtcagtaaatcctatccaatgcccttcccaccagcaatccctaaccgatgtatgtctaggttttaccagctgctgcctcccatgccttgctttcggcaagacacaatcaagacttcgtgacccgaccctgcaaagttatgactcgatcaacggtgatgttagtttgctgggccacttcctacatagttctgactaacctcgcccagtgtatgatctggtccttccttagccttggattttcacaatggatctaccagactatcaaaagaggcgagctgcgcaataagtatgggatccaggggttttgctgtggtgattgctgtgtgagcatgtgctgcggctgctgcgcactcattcaagaggaaaaggaggctgaaatacgcaccagacctcaggtcacaggataccaaatggcaccacagatggcgtatcctcaataagcaggccgtggttacgcagatttgttatatttgtatttatagtgaaagtattatacctaattgttgcactgaactttgctttgaatgcgtgaattcgaatatacacacacacatttctggctattctgttacaagtctttctagagaccaacacggcaatccttgtactgtagcgggattgttcactttggtggtcgttgtagagctttgataggtaccaagtctaatacttctagaattaagccttggagtatcacagcaatatctccgataattggcgagaattgttggtagtttgattaaggcccaaagaaaggttggccaaaagcgcccccgttttaatgttagtgttgacggtggcttcaacggctcgaagatcgtcaggggtacggcgatggatgttgaaagtactaatcttgttagaatttgtgggatttagccgtattcatcaacccacataaagtactttgtggtcatttaagggcggtggcactggacgaccctaggcctctcatttatgtatgcaggatcgaataaatcctttttgagtcgtttcgaagtcttgtcacctgcccaggtctgtttggtccattctacctggtatatccgatgattgagatttaagtaccatttcagggcacaatgccttgggtggaagttctctgctggccagggcctagtataaagcctattactgatatgaggtgcggaaataacaacttcattggctagcagagtagaattccacatttgccacttcagcgcatcaagagaaagaaaaccgaacattctaacgtgcgcctaattgtaaaatatagtatgtactatgctgaagcacagggcttcaccgagagaggacccacaaggcatccatgagtggagaaaagtcaaaatgcgaaaacgaacttcccaaacgggatttagagcccttgtccccacatcgcatgttcgtcagttggagtgcctgttcggtatcattcacccacctcagggcagttcgtgctcgcattgtagtcctacatggttattaagcacataattccatgaaacttagatcaatcccatagccaaaactagaaaaccaacaccgacaataagatcctactcctgtccttctgactacccctatcctccgtttcattgcttgtgcgctctccttacataatgaacataacctcctgttccccaccagcaatcccacttctgtccgtctatggcgcgaaatactttccctctccgcctcatgggtgattaacttcgcccacttcgtcccagccacattcaagtacaaccacaacaacgtggacgtacagaatgcccgcttctgtaacatcacggtcacctacacccaccccggatacaaggacatgttcaatgtcgagacgtggctcccaccccatgataaatggaatggtatcttacaagtcaccggaggcggaggatgacaagctggacgatggggtttatcgcaattctttatgggcggagccatcagtgaaggctatgccactacctccacagacgcaggcttaacagataacctcaacccggctttctgggccctggaacgtttcggagacgtcgacatcatctctcttcagaatctaggatcctagtcgctgaatgaccaggctatcactggaaacgaggtgttggggtgggggtgggacataagatttacttccgttccattacagcacacaatcggtatcttggagtcatcgccatctagcgcagttccatagtatatcagggagacagtcatccggtgctatatccaaatccatcgccgtaaatgtaccatcggtgcacatgaccgtggaagtcgcaatttcaggtatgttggcagataagatcgagcatggtgaagagtttgttgttgtacatgttttgtcactcggggagggggagagagtgggtggagggcgagggtcgcggttagacaaggggttgaatgacatcgttcgatgtgattcctgacgagagtgatgaatagcaaaacaaggaggcagaatcaagtgggagaaagaagaagaaagcgcagagggacaagaatcgtgagatgtgatggtggatggatggacagaacccagcgcttagtggaggcgggacactaacattttagtccctgtctagacacccgtgcagcgccacgcggaagtcagtgcccaggtagatcatacgcagcctcacctctcagtctacatctcggacatcctggattaattacttaaaatcactgggattgtccactgtatatgtagcatcgtaactttctcgatagaatttggaattgacagccttggaacccgttcttgatttgcaaccgcaaactgccaccttggctggtaaatggaatagaccggccatgatgcgtcaaagctcaactatggcctcattttctttttgctactgctttgtatgggcttacacatttcaattctactcatagattaaagaaagccatctgacaattccttcctcttcacaatcagttcagtattggtctggatattcaacaacacctgaaaagttcaccctgtaaatgctagcaatagctaattcccagacttctctctattattgccccgtagtgagtacagtcctcgaattctgaagacttaacaccgcctactgcactgctgacagagcttactgaagaattgctgggctttgtggcagatcgacttcagctctacaatcctcattcactgccaacgagagggacccacaacaaatgagcagaccttctgagtgttatctcctcacctgcaatttacctaacctcatctcacattaatttttactacaaaatcatctccccctacaacttcaactatcatcatcatcatcatccatcattcttggtccgatccgattcatcatcgtgtctattcagaatgtactcttccccaagcggtagttgtgccaagtgcgggaaacatacatccctgcagtgtgctggctgcaaaggcgccccggaatacttccctggcgatgttaaaagcatcttctactgcagtacagcctgccagagggcccatcgaacgatccacaagcccgattgtatgtccatgactcgtcggaagaagcttctgcgggctgctatcgtcgccaaggaggcattcttggtgtacagagctgtcgaatatgatcttgaactttccaagattgaacgacggggcgacactctttacctctctgacaaccagaagaatctggacattcctccccggcgcggcccctttcctgaatatctgactgccgacccggtgtatcgggaagccgctttgacatggttccaatgcgacgctgctcacgccctgtcgagccgtcatataagcaagctcctagcaggtatgatcaactcccagcctaagtctcctccatttacacgctgaaatacgtgaaactgacaccaacaagacgtcccctgcgcgattgagatgttttcgctccgaatcggaaagccgcatttcataacgcaggtcattcccggccccgactcacccaacatccccagcctcgacgcctcaaccatgccccattcagtgttgaaggtcgatcttcaactgtcgtcttttactgagagctggattgtcgacctcacaggtgctcagtacggcttccaagaagtccttgttcctttcctcaagtacatggaaaataaggaatgcgaattagtggatcccccagagtccttcgacatcactcagacacatgacctggacatcttgatgaaagaatacccttctggagtccggcgagctatagcatgtgcggagcgtccggcacggctgcgttttgctgcttttgtggataccatcgacaagaagatcttggaggggtcgcttggcgagttcgagaataaattgagtgcctttcgattggcattgaggcagcacatgtcgaacaatacccagcgtgtttgaaggtttgctttaagtgttgatactctaagatatgaatctggggagggaatctatttgggatgcacccacacaaagaatgttgagaaaatagcacattaatcctgtcgggaaaattgaaagaggatggtgtcattcatgactgggcataacatactgggtgttctttttcttacatgatagttccattgcgtgcggcggcctaacggtcagtcagtgacacctggacagtgatcacataatcccccatcaactggttccaattttcgactgaagatgtttgcaagttgctacctagctgccaaaggataaaaagtcaatcttagcatacgaaaacccagataatataatgcagctgagccgttcatctgaagaaacgatgtgccgcacacgtcttcacgttccattcctcaaagttgccaaagtccagtaaaaaccacagccaaaacaagataagatttcaagctgggcattgagctcgacgtagatccagacgtcttccccgagctacaaccaaccgactcgagatggctacccatcgtaagacactccaacagagtcgactgggtttccttggtcgcattgcagtaagcggaacagttatcctcgccgcagtagctgtactgattgcttttgcagcactttactaaataaccgtaaggatcttgtgtccgattaagtccttgctgccagatagtagtggcgcagtaatacggataaggcagattgggtatcccactgtggcccgcacatcgctcctgctccagggtactgtttgtgatgttcatggtggctccctagaccggcggtgtactgggttgtattaggagagataacttggacacatcatgaggacagttactcacggtatgagcgtcggactagaatgattaacaatctaaaagagagagtagaacgaacaataaaatgctcaatgcctttcggtagcgggtactgagtagaaagtttcgagctacttttggggaggtgcggggcttatatgattcccaggaggtacatttagacctaaatttacgtagcacttcttcactctctaacttttgagagatctcttcgctccctgaatcacagaaggactttcatcacttgatatctcactaggcgcaattctttactaagtcaagagaccatatttttcagaagtgcgagcgttacatgctgtgtggccatgaacagcacccctctgaaagcctagcggtaacatggtcactacaaactactatcacctctagagtaaactatccgttatacagggtcgcaattatcagctcaataattggttttcggatcgcgcttgtataatctaaatggtccatgtacaatgtgattcgaaggatgattgcatttcggcgtctccagacttccccacggagaccctgcatcgcagggaagatggttgggccaaaatcctgacatcttggcggaatcccccatgccaatcatgtgtgcactagtgcacttagtttacaccaatgaatgaacggtgttcaatctctaagtcctttcaaaaaacatggctgccttacaagtctgactagtaattcgacctaaatcactatactttcactactgatatataccgaaatccaatccctgaaatgagtggcaacaatttgcttcctgaaagggccatgtttatgatttcatatggatagtcagaagagacagatgacattctaagacataaggctcagcgggtgagagtgtcatatgatatgttataagtgaaagtagcctctgacaggtcgcacggccccttgagttggtaatgcattccctggtatccttgctagtgcattgggatcagactcatgcgacaatgacctaacaactacatgggccgcgatgtaacgtcactaatgtcgtccttttgtcaactgagaccggaacacctattcgctagctttttaaaaaggagaataacgcgttgtgcgagaagtgacagtataagggtcgctacagcggcaagatgcacttgggaatctcagggaccttgaaacacataacccacgattccatgatgatgatattgatgtctttcttgacacttgctgcaactgccttaacggcgccatcgcttcacatccgggaagacctcaggtacgttcgagtaacagtgcaacaacataagatcacatccaagcagattgtggtgagagatagctctactgaaatatcatcggctctgcctgctcaaatgtcttgacaaccggagtgtttgccgacttcggtatcgtcgcagatgttgggtctaacggcgatggcaatatcactgccgggacttccaccttcagcgttcatgagaatccccagtattctggtggtatcactttttacagaatgtacaatgataatgagtcactcatggtgtgcgatggcgttcctttgcccagcaccgtccaattgaacccagttaaagtgggcgacatatccccttgtttcagcgatcaagtcgacataactttacagcgagcagcggagactgtccacgttatggacacttttccaatgcctcgtcgtgaagcaaattccactgacgctgtgtctatgagaaatttggagcagcgacaaaccggcgcgtgcagaatgtggtcacccgctaaggaaagttggagacggcgatccccatcagaactattggcggaaacagttgggcgtgagccgataatgcactttcctttggtctggtgctagcgactgatgtgcgacgaacaggagaatctggattgcgggagcgcacactattgcactgttggcgcatctcagtcaaagtcgtatacagttggatggacggctactgcagatgcatcacaatggatctctggcggctttgcggtgcaagcgagctggacaaccgggcttgactatcaatgcactgctagctcccatcagaccgtctgtatctggtacaacaccgctcatactgcgtacactgcccaaaacggactttacaacgtgtgcacggggttcaaccccaataatgatgccggcttcgtcatgttctccccaaaccagaacaacaaaggcggtggattttattgcgttattggcacatgccgcagccaggggcagaattactgggacaagagtggtcctgcaggtgggccttgactgatttcaactggtaccaatgatggtggacatgagacttattattgtgaagggagtgtgttattagtggatcagctgtattagaaaatgtttttctctgattaagtcttggcaaagaagtctcatgtcttagttggtctgaagaccacagtctcaagtcagaatcaggcttgtgaaagcgtatgcaccttcctgcttccatgtcctggttcacagcctctcggacagatgcaacgggacacaagtccttacggacggagctgatatataaagacaataggtgagaataatcgatcacaagtgaggttggactgcttggtagggcagtcacttgttcggaccattatcagacgagagggggtatccactaggaaccgaccgaatagtagggacccactagagaggagggaccaactcaagatcatgagctccgtggagggtaggaatccactacaaaggaaaccactatattccagagccatccgagtataggaccggataaagcaaggatatacggagagtcaggtggcaccaaacagtagaatagagacccatcgcaattatggaccgactaaaatgctctacttccgataagatattctacttgtcttaaaggtgtcctttttaaggcagttctttctattatcccgactgggctcacgaaatgtccgtaggatatgcccgatttgatacggcgcagtattgttttgtggctgtacatactgattttgaatcttgcttatcgttctgtggtcatgtaaccttatgtcctaaaggcgcttaaccgaacggcttgtggcgcgtttgctaaactcggaaggtggatttaatcgcgggttttgtttagcgcgtgttcggttatcaagcatcgataactattgtaaggaaagaccatatcgtgtagggcggtccaaaagtggagctgatacattacagaccctcagacagcattagcagtatagggaaagcctcataattgatgtgaacattggcgcatgctaactttgagtatgaccatggcacgttcacccaccaaccctacgcgatgtggggcaaaataatagaacatagcagtttcggaatttcccgccaggtgtctttctcgcatttccccttggaaagcaccgaggcaggaccatctgggtggaggatgggtagatttaggccattctacctgccttgggcaggtagcgataacaattaacgtaaaccttggggtatttgtctcaacgaaccctgtattgctgattttcagcacactcagtcgggaaaggatctcacacagcagatgctgaagttcttttccggtacagctgatatagctaggtttatgaaactttttattgagtatagtaatctgtcattcgtacctgcggacatactgtgatataatgaagtacaaaattaacagtccgtgactcagcgacagggccacctctcctccgttactccatcccatgtaattccagatacttcgcacaagtggagtaaccattgcgatataaggtaggctaaaagattagcttcaaaaatttggaaagcattaatctaagaaatcatacttacgtccacggactttgcacgatattccgaagaacagtaacggttcgcgaaggtgttgccgaagaggaggagtgagaaattgacgtcgtggctttttcattggtacccattttgttttattcgacagtagaaaatattagcaccgctggaggcaaggatatattgtgtggaacagttgcacccaggtacctaatggtagatgattagaagtccggtggctacttcgaggtatttatgtacgaaggctagcgctaaccccactagctttgcaagggttcgtaggccggctatcaactgttccccaactccacatcggagacccatggttcctctcatactaaaagcaccattatttcaatagctcatttttatgtgggtagccattatattatgtctcatgtgcaaaccgtacaattcaaagtcttgtatgttctaaggagaatcgctcaacaccaacatacggctataaatatggcgtagcgaaccccccaaaaatgatttcctaagtggcacaaccatcttaaagcatcagcatgaaactctcaaccttcctcttctctcttctggctacaagccaggtcactttagcgacaccaattccaatagtggatgttgctgaacttccttcagacaccggtcttgaaatccgatctcctaacccggctgacgagctgctggcgattctagagcagcgggatactagagtctgtgagatacttaatcgaacgattcgttctattggtaccagcaaatttacgtatggcgcatgctctcctctcgatcaacaataatcctcaagggactaataatttctagggtcgtctatatcgtgatgggctcacgtcttgctcgacaagtctgtgaatatgccggtggcagtagatgtgaggaaatatcttatattatttcagacggtctcctcttggcctatgttgctgccgcccattactctggagccattcccgaaggtctaccgggtaagcgtgacgtcgatgtctcccaggattatttccagctgtgggagactatgctgtcaagtagtggagatatctcctatgattatctcactcctctctcgaatacctcaaatactcttcccttggttagacgccaggatcagcctttaccgatccacagaattcagattactggtttcgcccataataactctccgaagcacgatatcatcgccaatcactatgaaaatggtgacaccgttcttcaacttcctcttgcaggaggggttcctggtgctaatgacactgaaggacttgatttgaggaagcggtttgacaacccggggtttaagattgcgttcactaccaggggtagatcacagctcactcaagcccatcaaaagtctatggcactggcaggagctgctacatgggctgtctatgcagacaatgccaatcacaagatggatgacttcatcggttttgctgagactgatcatgcggctaacttctactaccgaatcattccggagctgagaggattcggaactaattacgagactgttgatatttgtgggggaatggcatcgtacttgtgaagagattcggcaaatggtgaggtcgctgtcgtggatatgaaccgatcatgcattgcttgtcaatgcatccatcatcgcactgacgaccagtgaggaagtgatacgtgcacgaatttatgaccgcatatggaaagaaagaaatgaaggtcatattaccgataaggaaaaagttgctagggtcagtgtgggtacgggctcagttttcatgcatgaagggcagtcgctttggtttgcaattgacctgacatgcatcatgtatgatataaatcctcatattaggaggtgtgagaagggaaaactcctatactactaagaccagaacaagattataactaatttaaatcctatatgaaaaccttttttctattctccatatctaaacaagcaaagcaacacccagagtaccagtatataccacataattcgcacatacaacctagtataacaacagcactaagcattaaggccgatgccgatcgcttgtggcttcccgccggtccctctcgcgcactggccacccattcaaaccagagacaacagctaggaagtgtctagataaaacttgtctaatgcattggctataattttaattttttccgtaggtatgagatgggcagatatgcgaccaagaggggcatgaagtgcggagttgagtcagtctgttgaggtaggttaaatgagtctccttctggtagacacttcactcgagtctgtccccgtgacatctccttcggagtctagtcttttcatctcgctgtatcagaaacgaactcaatattgataagattacaggtatggtcttccctgaccttccctgaccatcacagcagctgatgattccctatgacacaggcgctgtggggaccggccgtactaactagtagacgttagtacttagtagagatcaactaatccataagtgtagagctgacactgcgccagttctacttagcgtgggggcctttccagaccccagtgagttgtcactctatttatgccggatcacccgagccatgatccctgctcttctccaggtttcaaattcctagattcagtctgtccttccacctgcccctccgcaatgaccacaatcaacggtcactgcgatccggccttcaccggggtgcgcgatctcctacagcaattgatcaacaatgaagaagagctaggagcatccatctgtgtcaacatcgacggtcaaaacgtcgtcgatctctggggcggccacgcagacccagcgagaaccaagccatgggaaaaggacacactaaccgtggtatggtccgtttccaaagtaattaccgccatcgcaaccaacattctcatcgaccgtggcctcttagacccaaatgagaaggtctccaaatactggcccgagttcgctgcgaacggcaaggagaatatccttgtgtcccagatcctcagtcacacctctggagtatcctcctgggagcttcccaacaccttagacgacatatacgatgcgaaaagaggagccgataaactagcccgacaggccccctggtggacgcccggcgaacactccggctaccacgtaaccaaccagggccacttactcggcgagctggtgcatcgtgtaaccggaaaaccgttggatgagttcatccgcgacgagcttgccagtcctctggctgcggacttccagctcggggtcccagagaaggactggccacgaacagcagacgtttccccgccgccgccactgagtctcgacggcgttgacccgcagagtgttatgttcaagagctttgccagtctgcctataccggcggaagaaagtatgagtcctgggtttaggaaggcgttgattggtgccacgaatggattctctaatgcccgaggcattgcgcgcattgcgtcggtcatttcgcttggaggcacggtggatggaaagcagtatctctcgcctgaaactattgaccgcatgctggaggagcaaataagtgggccagatttggtcttgatgtatcatttgcgttggggtcttggtgttgggttgcccgtcccggagacttttccttggttgcccgacggtcgcattgctttttggacgggctggggaggttcagttgttgttatggacctggagaaacggatgacgattgcctatgtgatgaataagatgggacaaggcacgttgggttcggataggacggcggcttatgtgcgggctgtttatgattgtcttgcatagatagtatgttaaggctcgcgaatggaacacgatatataaactgaaaatagtcaagcggttcaaagtctgcgcccctccattgcgaacactgattagaagtagtaggctgtcttgagttcttgtgtagaacatagtggtttggcaggagaagtttcatttgaaaaaaaaaaaaaataaaaaaataaaaaactaaaggtgtctacgttcgttgtgactgatggggtggttgtacgctgccgaaaaaacaaaagggcaaaaaagaatgaccagactggggctcgatcccaggaccttatcggtgttaacgatacgtgataaccaactacaccatccggccaattcaatgaaagtgactgtcacttaaagactcattatcctatagaaacgattccgagaagttcttgttggttagcataatcgttgggtcggctgtgctgatttaggctgcgacatagcggtattggataagatcttcacgccgctctcctgagtcggatccaggcagagctttaatcggtgggaaagattcagagctctttcaaactaagacgtaatgcatctgtaagtttgtaaacattgacatggttcgaattctcaaggtctctaaataattccagacttggaagcgctccaactgagattaagctcaggcgattacccagaccgccgctgttagcataagacacgatatgacgggctttgaaataatacctttagcattgtatccaagatactgatctgaattatgaataaacaatatcgggtttcagtctagcaggttgaccttactacttcgcccgagtcataagtagattcttcgtgacctcttacttggctctcatccgttctatgcttcgccctggcaagactttagctatagttgcactaagctatacaattgatgctaggtattatgaatcagtagatgaatcaaaggctctaagagtacataaagatataaattctacatgggcttttggtacatgggtataatttgggcggcctcgtagcctaaggcagagttgtgcgtcgtcagcttttagcgcgccgaactcaaccaactggtagtagtcatcctgcgcagcacgtcagccttgtgtacttggtgccttctactcatcaacttagagatccccggaagtgctactcgactaaacaagagcagattctctctagtcggtgaaggcacctcacgatgtcgggaaatgacgtaccttcttacgatgagtttgccgtgggctggatctgtgccctaccactggagatgaccgcagctaaagccgtcctcgacgaagaatatccaagtctacatttacctaagcagcatcacaacacctacgtgcttggaaggatttccggacataaagtggtgattacatgtcttccattcgggatttacggaactacgtcggcgactgcggtagttgagcagatgctattcacctttcggtccatccgctttggcctcatggtcgggattggcggaggagtcccgtctgctgtcgatgtcagactgggagatgtggtcgtaagtaagccgactgctggccttcccggagtgatccagtacgattatggcaagaccgttgcttcaggtcgctttgagcagaccgggacactcaacaagccgccgatagttctcctatcagcgttgtcgtcgctggaagcagatcgtctggctggaggcagcgacattggtacctatgagaagattatcgcggattctctaagggctgccaaagatccatccgtgtttcggtatccgggtgccgaacatgattggctcttcgatgcctcctatgaccatgatcctcgcttcgcatcctgtgctgagtgtgacccagaacgacgggtgagacgcaagcctcgacgctcatgcacaccggtcgtacattatggcaacattgcgtcgggcaatcaagtcatgaagcatggcctcacgcgcgatcgcattgcgcagacaacacaggggatcttgtgttttgaaatggaggcggcggggatcatggattaccttccgtgcctcgtgatcagagggatttgtgactattctgactcccacaagaagaaagagtggcaggggttcgcggctttgacagccgcggcctatgcgaaattgctattgtcgaagattcctgtccatcggagtgaggcgtctacgctgatacaggcacctggttcgaagaatagtagtacgtggggcccaagcatggtgtactttatacccagagagctattactgatgttaatgaaggcgattcgttcgatgttcgcttcgacacaatcgaaatgccacaggctgccatttctgtgggccgggaggcagagcttgcaatgataacgaagagtcttctatcagacagatttcgaggcattgtcaccctatatggaatgggtggaattgggaaaaccgaactctcgattatgtacatcatgcgccatcggcaaaagtattcatctgtcttctggattgatggtagcagtcttgacaagttatattccagctatacacaagcggcaatgcggatcatacatgatcatccaggtgaccagtctttgagaaaggccttgaaggaaggtgatcagattcaattggttggatcagtcaatgagtggctgagtcgcccttcaaacaatcggtggttactcatatacgatggcttcgaccttcctatggtcgaaggttttgacaaagccgaaatcatgaaaatgagactgcctccaagcaagcagggtcatatcattattacaatgagaagttatgatattggaataggtgatcagattcaagtaagaaagctggcagcaattgatgacggcctcgatcttctgactcatgtgtgcggacgaccgaatctacgagatggcaagtaacccgtcgtccctgctatgcatttctattaacagctgactggtactacttagacccctacatcgcagaactattaactcagctagatgggctgccactggccatcgtgtctgctggggcctatctcaaacagagtgtgataacttgccgcgagtatctcaaattatataaagaatcttggctgcagttacaacaactatcgccgcagcaatcttcgcttgaacaaaagtcaatgcatacaacgtggaaaatcacactaaaccagattatgcgccagcatagacatgccgccgtactgcttaagcagtggatagcttttaatagtaacgatatctggtatggcctcttccagagtgctcgaccagaatcagcgtccgaccccttagtgttcgatacagcaatggctgtgctaagtaggtatggatgggtcgaaccagggcctgtcgcagcaggaaattctcagcagggtcggggctatagccttcaaaaatgcattcatgcctggcttcaatacgaggactgcttcgtgtcagatattgacctgctaacgcagcttgcagttttgaagatcagtacttaccagttggatctggtcaccaaattcaattttttctcactggaactccctgatagaaaccgtcttcttcctcatgcagaccgatgcctggaaatctatctttctagcggcaaggataaatacaacagcctctttgatctgaaagcgcagttacgacttgccgatttatatatgatttggagtacccgggcctcacccatctatacttgctatcttgatttcctgtgccagccatatgaggaaaagcgaaatctggccaaatcccaggacctctactgtctcctaatggaaaagcttgatatgcaacaggatcagtcgaacagggaagtgcaagatatgatgtccaaggtgtatcaccagcgcgggcttatcatgtttcgcaaccagcagtttgtcatggccagcaagatgtttcgattgtctatccatagtaacgctccggcttatgtctcacatataaagctgacgcagtttttgagcgggccaatttttcttatcccactaaatgggcttatcttctatattttacttcgagaggaagacttcaggaaggacgtcccgctaaatatgttgctgctcttcgtgaaaccaattgtgtttcttcacttattgatatctcaaaggatgcaacggtggaaaaccttgttgctgtgggcagttggccacgcctgtttccaggtgtattactcgtcaattcagcctacgcttaattggggggctttcatctgcggaacatatggagaggtagcaattgtattgctgctaatgccaatgctcttccgtgaggggatttattaatccttctctttgatccgccccgcagagacgaaaaagcgaaaaatacgacgtacattgtggctaatatgaagcatttgcgtgtaaattagcgtgatatatcttctttcccgctcatacctttcatatttgagccataccatattcactcaatttataccctagcatcactttattttcctctatacctccaccccggacaagatatctacccaaacaacctctccctcctcatccccagcgaactcaccacccccaccgctccggccaccaacggaataataaacgccctggccatcgcatccgtaatagccttgatagcccgatccctcaactccccactcaagctcttcaacaacgtactctgcacacccgctacagcattccgtatctccgcctcactatatcccctcccatccaacacccctttcagattctttactgcagtagactgaaacacctgacttgccaccacaagacagataactgtagctccaatctgcgccacattctgcaaattgatcgcgctgaagatatcctcgggaggcaccttgagactagctaccgcataccccagctgcatggtcatgccggtgccgacagccatgaggatcgtgaaaccgtagatctgtcctgccggggtagagggtgagaggtatccgacaaagagggcgctggcgagggtgaggaggatgcctgagatgaggcacagcggcatgtaatatttggcttttgggaggagccagccgatggcgaggttgatggtgatcgttacgaggaggtaggggagaaggcgcacggcagccattagggaggagtcgttgcgcgtgaactggaagtagattgggatgtagaaggtcgtgaagaacatggcggtgttggcgcaggtcgttgtgatgtagaggaggatttgggtgcgggagcggaggagatggccggggaaggagcgcgtttggggcgtagtgaagatgcataagtattgttggagggcgtaaaggatgaataggacgccgaagagcacgattagcgcgatggtggcgccggagtcccacgcccagatgcctcctgcagagatgaagccaagtgcgaaggtcacccacattgccgcgctgaggacgaatcccagatagtcgagtcgcgttaagcgtttgcgaagagattggcccgcgccggggtgaatggcggggaggtagaagaggtacacgggggctgtgatggcgccgattaccaggttcaggtaaaaaccccagcgccaggtggcggaggagtcggagaatccgcctcccacgacgggacccaggatggcacccacgccccagacaaatccggttcctgtaagataggtgccgcgctcgttgcgggtggtcatggcagagaaatggttaagtccaccgagatagattcctgtacctccagcgcctgcaatcacacggccgacaataagggcgttcatatttggagcaccaccacagagagcagaaccaccttggaataacacgattccagcaatgtagagccacttcatattcatgacggtatagagaaacccgtaggggagaatcacggcaactgaaccgagtgggaaaccggctccaatccatgcaagttgcgacacgtccccgaatctctcaatcacggcgccctgcacatccgcagcgatggttgtatcaagtccatacatcagagcagagagatacagagcagcgcaaatcagaaaccatcggaaaccggtaatcttgcggacatcatcatcggtggcactggcgtcggcgtcatgtcctttctcatcggactcttcgcgatgagggagatgattattcacagcgaagtctgattcctgactcgagggcagtgaatgcgctgcagcttccattttggcgaacccgagagggctattgtttctcgttgggaggactgagcggctggggaggatcgcgcatatgtatagtgtcgagacagggcagatcacccattgcttctccttatgtccgttatgaccggcggaccacgtcgtggattaaccacgccagggacactgcaggacaaatagtctctaaaaacgaagctctagtgcttccacgatggcgggattaggagtttagcattgtctatccccgtgggaggccgggggatcatcatataacaaacacgtcgctcacccgaaattcgtcggccgaagatagaatggcccacgcactcacccgacaaagagcacaatgcatccgagatcaccccaaccaacaaccggagcacgcactggctccaatgcaaattcaaaactcatggactattgccaaaatcctgcccgatggcaaaatgcagatcgtcgaccggcccgaaggattcacactggatacagctctcgggtggcgcccatccacgaaacgtaggtagcgatttgcttataagcttagaagcctttcattggggttgatctgaacctaacagaaaggaaaagaaggggattttgttgtggctaaacacacagcaagaagaagaaaaattacctgctaggtcgacacagggctacgtttcgatgatcagggtctggaacatgtatactaatgtcgtactattttctctcatcattactggacaatacgagtagccaatttaaattgcatttcaaatatcctgagcaaactaagtgcgctgggtacagaaacattggcctcgggttgcagcgcctgcttgttatgcgcttaccgggatctcagacgcaaatatcccttcttggcgcggtaggagatgtcgtaggttgcctcatgaccagccaatgcctcaggtacatcgagaaaatcaaacttccaagtcatcatgacagtcatgatcctcatctctagctgagccagtcgccgcccccagcaagcccgaatgcccagcccgaacgccaactgcgggtacgacgagccatcaaactcgagttcaccgcgctcattctggactagccaacgctccggatcaaatgcctcaagatcagggttaccaccacctgggtacttccgggtcgtcttcacgtcactccagtacagggaggatggcgaagaggagtagtccggtccctgacagacgagaaggacgaccgtgcctttcgggatccggcggcccagaagctctgtgtcacgggtagcgtcgcgaggaacaagcatggcagcgcgaagccgcaaggtctcctccaatactgcgtccaaatacgggagtcggaattggatgatctcagctgcagtgggtaggcgaccctcttggactgcggccgcgcatactgtctgcagctcgtcgcgaagccttgtctgaacggcaggatgctcagccagtagcttgagaatccatactagcgccgcactggttgtgtgttggccggcaatgagatttccgtatgcctagatgcaatgacccggtgtcttagtagagatttcagaggccgaaagaagctgtttacccacctcgtcaatcatgatctgtttgccatacataggctgccggtcggccttgcgagatgacttctgctctctatacaccatatagtcaataccagtcttagcctcttcgtcgttgccgaagcgctgcagtgctaggttaatatgcttgcggataaagcgatctttgccgacgaagaacttccggtaatatggggacatgtaccgtgcccaccaggacacgatggagggaggccatttagtcgtgtagatggcagccatccggtcacccacatcggttaaaccctgttggaatgggtgcaacgaggcctgaggaaagatgacgtcggtgtgcttcccaacccctaactgagagttgtccagctgctcgacaaactcaatttgcctacgcagagccgagtcctggaagtcttgtccgaagtggaagcgcacgataacatcaagagctagggttttcaggtcggccagcatactgaatggccttccatttgctacccgggctttggattcccaaagatggataaggttgagcaccgaagagtggatgatgggacccacggtctggtgcagatagtgcggagctagaaggtctttcaaccagctgcgggaggttctccaggagtccccagtcttcatgttaaggtggaactctccaaataacgggaaccgatcgataatgtaagacgatcggtcgaagtcacttcgtcccatcagcagctcgcgggtctggccgacgtcagccacaaggaccaccggcttggagagcgggcccatcagcgcctggcatatcggagacccatgctcctcaagctgcttgctgcaccacttagccagtccggcaggatcgcccctcagagcaggcacgtcgcccaaaattgatgtagcggcctgcttgttgtaaggaattcctggtaatgggctcgggagaagccatcgataaaggacgtataaccccaccaggcaaatcgtaatcgagaagacagcagggtatccatgaaaaagctcaacaaagctggcaatgtaagaaggcgccattatgtcatgcgaccgatgaattttgtatttccaataggatttggacaaggtaggcaatatccaatttaccttccggacggctgttctgagctaaatattcatggatctttgaggccaagtataggcccttaatgctaatactaatcatgtcttcggaataaccaacaacgaggccgatgttctttggttcatggatcataaccgtatattcctttcggccatcatcgaaggttagatactgatttggaaagccccgcttccttctcagccacgcttgcagtcgagtgccaatgtaagaagggagtgatgtttcgggtggcgggctgtgttgaaagctcgtccgaaatatgtcggccgacgaatatcggggattatgtcggacgcacctctacccgttaattcaccccacggaagcgagcaggttcgacctggaatgtagtcagactacgtgaatatctccttctccatggttgcgtagacacagtggccaccctccacatctacaaatggcaggtgcaggagttccgaatccgttaatgtaagcactagcagtccatcgaactgtatattccgctaacaactatttactgcttatcgggttgatgcttcaccggaaaatccaagtgaaggaagacctgctacgaatcacgaacgccagccttgaacgggtgtccatatcctcgccggcagtgattacaagcctgactctgcttggaggaaaataattccactttacgagtggaaattgccattccaagacgtgaggtctagagagggaaattgcagcattgagtatgagtcaccgtgcgctattgtggataacatgtctggcatcaaggtcggatcctctgaagacatccagagtccagagccgtcttctaggttgaggaagttcgaaaggatggctggagatgaagagctccggcttgactcattaggtgtatatggctcgagggaatgctccatcctggcagccttcgcaaaaagctgcgtcacaacctgtgccccagaggcagccatttcgctgacctcagctaacatttgaagacgtcccagggctttctcaaccgcccgcattgcccggggccgagtcagagtggccactcttaagccgagaatatcgggatgatcctcgccttgatcaaatggaaagtctttctgcgtacaaagtatcagaagaacaacggcggcttcaaacgtgttgaatatgatggcgctgaaacgcgtgtgggagcctccaaacatgatatgcagagctgtgacggcatccagctcttccagagcggccagagccagcttctgcttctgcgattggagaagaacttgcttataagggggtagactggtgacttggcctggtttcagcaacagtaaaggacgaaaattccaacagactgaatcgaatatggcaatgtagagcagctgtctctgcatgggtaatttaggaagttggccgtcccacctccgatctggattcagtgcataggctggtggtagggtagggatatactctgcgcagaatcgctcataccgctgttcgccgtgagtagggtcgtacggtaggttccgtctggaaccgaagcttctccagaatctgcccagccggacttgcatgagacgctcggtgaagtcttcaggtgcatctgcagacgcagccaagtcgccaataaacggggcaagacgtaatcggggtaaagtctcaaggacaaggttatcagggagaaaagggacccggtcaagctgtcgggcgagatggcttattgatccggccacgtcagcgcaaggttgcagtgccaagagcatggcatacgcacctgtccagaacatacagcccacataatgtcctccggcgcatctccttttctaatacttgagaactatcttcccccggcactggagccactgtgtgaatccccgccttctgcgccgcactacaagcagaggcgatgccttcccaaaatttatcagtcctcccttcacaagaggatctgaaagcggcaaataaaatgtgctggacccggaccagagaccctttccagtttagagacagacaggctctggcaagctcaccaccgagatgactgcaggtgtcacgtatgtctgagagtgactgcccccggatccgatcaagggtgtgcgtcggagaaggcaggaattgcgccgagtaggcaccaatccgaagtaccagagcggcaaactcaatgtcatccacagacaggggccactccttagtccaccaatgctgatactgtgtcagaaagctgggtgggtggatgatctgtttcatcctgttccatggggcatcagttgaccatgaatctaatatgatcactaacaagggacctaccagttcaattcatcgacgaaatactgcatcaggaaatctaggatgggacggggaggaattttttccaggacttgtttgactgtctctagcaccgcagttgacaggccctgggtgctttgatctgtgtccccttcactgtccagatcccactatgccgtttgagattagccatatgtcaagaggatggatccacagttgcatgtgtgcttctcacttttttgagcagagccatggtattggagtcactgtgctcgaagtagccaaaggatttagccagagctgagtgtgaattagacgcgctattctgtgcctcggcaggcgaggccttggaagatccatttggtaactggacattgggtggttcctggggctcagggtctctcgctggctccaagaggaaagtgttggaggggtctccagtaatgatggactggtagacacattcctccggccgtcgacgtcgggtgcaatggttgcacgggtactggcggttgcactaattttttttttagttcgcattaggactcaagctttcagctgcccagtgtaggattagcgatgtttacgcactctctgtttcctagtgtagcagggcacacaggtggtgacccgacgctttcggccggtgggatgcattgcggctcctcccatctggtcgacaactcacacaacaccagcgggcccgatgcccttgttatgtctagctgtcgcacaagattaagctattcttcttccagataattataccttagtggagggatgagggggaatatctcaatgtgggactgtttctgtgcctggaggtcgcttcggggtagtgggggggcgtgtctccaccagcatttgggagggacaagccagacagacacagaagaccagataggcagactgtcagaccgtcagacatttggggtcagacggccagacggtccgtgagcctgcatggatttaacttcagtccggataagatcggccacgcggaacggaagaacccgccggatctacttggttatgcttactcggtttactcggcttcaaactctcatcaacaggaaacgtgcggctctctggctgtttctgatggtgttattggtggcctaaatcccgtgcatcccaattacactgaaactaaccctcctgatttgttcccatggcacccgggccatcccggagctgtgcctaatatgcttgatctatcacgtcctgtgaagtacgttcaacgtagactagactccagcagaacctgtaagatcagacaagctgcatctgcaaccttcaatgaattcgttgaccagcaggatcgccacgcttatctcaacaacacccacttggagccgctcattgtactgcatatcacatttttgtactacgtaccgtcagtggtccgtgcgagtgggttggagcatggggaggatttgatcttcgtcagagggccgttaaccccataattatcaacagtctggtttcatcccatctcggcaccttttaccttcccaatatggcatgcttctcagtccggcttgcttgggatcccctcaatctggggggaaaggaaggtggggaaggatgaagggggccaaaaaggacctctgaggaagaggtctagtcttaggcgcccgggactgtggctgaaggtaggcaatccttccatttattgccaatgacagaagccagcaaacttcggctcgcaacagagaaggaatcgaatccatgcgaagtgtctcgcttctgagtagtgctgacgaaagtcacggccccgacatccatcggtcgcatcgggcgatttcgcccgtccctcctccgtccagcttatcacgatcagcatcaacacgagccgccaagaaaaggaatctgaggacttgtctgttcctccaacgtcttcggccgaggtccgtagacagcacacggcgtcttcatcaactggaatacccgaatgtgaaggctgccacgaaacggccgacgcggggcttaatgagtgcagtagcttcatgcacgtatggtgaacatggcagcagatacaccatcagaaagaagacaactacagctattcaccgtagatagtgcaggagtcaggattcaagaacaggatgaattgctatatagggcctgtgttgccatggacgagacagttcatttggcaaatacagcaacttctctattgaattcgacaaaaagcacgaacgatctctatacttcatctttaccactctcatacccatattccttactgagccatcatgacacccccaagatcaaatgagtgcgagccaattgccattgttggcatgggtgagttgattatatcgggctttggagagaaatcaagcattgttaacatgaataggctgtcgcctaccgggaggtgttcaggacattcctgcgttgtgggagttcctccgggaccagaaggatgctcacggggagtttgccgcgccgcgtttttcagccgaaggcttctatcatgccaattcagaccggcctgggactgctgtagccagcagtggcttcctcttgaaagaggacccgcggctttttgacccgtctttcttcggaattaccgatgtcgaagcggaaaccatggacgcctcgcaacgcaagctactcgaagtgacgtatgaagcatttgagaatgcaggggagacatgggacagtgtgtccggtagccgaatcggcgttttcgtcggcgatatctcgttcgacaattatgtgtcccagacgcgtgattgggactatagcggcaaatactcggctactggagcctttcccaacatgctggccaaccgcatccactacgttttcaacctcaaaggtccgagtctgctaatcaacagtgcatgcacctcggccatgtatgcgctccacctggctattacctctatgcgcaatggggattgcgattcggccatcgtagccggatccaactgggttatggaccccaactgccacattgctatgggcaagctgggagccctgtcaccttcttccagaagccacactttcgatgcctccgcagacgggtacgcccgcggcgaaggtttcgcagcactctacctaaagacagtctcgcttgcaacccaagatgcgtctccgattcgcgccctaatcagaggcagtgcggtcaacgccaacgggcgtacgagtggtatcaccaacccgagtggccccgcacaagagactgtcattcgagaagcgtgagctctatccatgttacacactttgcacctcacgcatgaccttctaatactgacttgaacagctacaagaacgcaggggatctcgatccctccgaaacaacccttctcgagtgccacggaacaggcacccgcgttggggacccaattgaggtgacggcagctgggaatgtgtttgggccatcacggtctactgtccatgaagatcgcctggttgtcggatctgttaaaactaacgtgggccatctggaaggtgcgtgcgccttgccaggtatccttaaggtggtcgcttctctcgaggccggagagatccccgcgacgctcggtttccagacccccaatccacgcatcgactttgaccaggccaaggctcgcgtcgtcaataagacagagccctggcctaaagaccgacttaagcgtgccagtgttacttcggcaggctttggagggaccaacggacattgcatcatcgaccacgtccacaatgtcatcccggagtatgtgaagcctggcgtcatttacgagcaagttgagcagtccaatggtacaaacgggcatgctgttaatggtaccaatggcactaatggcacccacggcaccaagccagaagcactctcccagctgcaccgtcctatactccattctccgaccctcgttagacgggccgatgccaccactcgccagatggtggttctccccttctccgcgcacaaccagtcttctctgattgcgaacatggaggcgctgcaacgatccattcctcatcactcattagccgacgtggcctacactctcgcagctaaacgctctcgattctcgcaacgagccttctcgattgttgacaaggaccaggtcacccaggtcggatcggtcaccgacaacggaccaaaggtgttcgcctcgcctcaacgggtaaacgtcggttttgtcttcacgggtcagggtgctcaatggccagccatgggggcggagctgtttgagtacgctgtgttccgagatacaatcgcatacctcgacaccgtgctggctgtgttgccccagcccgctccatggaagcttgtagacattctgtgtgggaactgtgacaaggatctcatccagaagcctgccgtgtctcaaactgtatgcaccgcgctacagatgggtcttgttgacctgctagcatcatggtctgtccgcccggctggcgtcgtgggtcattcatcgggcgaaatggccgcagcgtatgccgccggtcggatcacagccgcagaggccatcaccattgcttactaccgtggatacatggtctcattcaaccagaaaaagggtgctatgttggctgtcgggcttggagcagaccagggtgccgagtatgtccggcaggccggtatggagggaagagtcaaggtcgcggcgatcaactctccggcgagcatcaccatgtctggtgacgctgatgccattgagcagctgagcgtccagctcacccaagaagctatctttaaccgacagcttcgcaccggaggacttgcctaccattcacaccacatgctgtcatttggtcacgattacgctcaggcagttgatgatgggttacagcgtcttgccagcctaggaatcaatgacaccacttccaggtactccaacattccttgggcttcttcagtggtgccacaaaaaagctcaaccatgcctcgcgaggaagtgactgcttcatactggaaagcaaatctggagtcacccgtacggtttaccgatgccgtatccaagctcctcgacatggatgacctgagaatcggcgcaacggtggagatcggcccacacccagcgctgaaaggcccattggggcagatagtcaaaggtctgggacgtacgattccccacgttgcctcggtagagagaggccaggattctcgccgctcgctacttggactcgccggaacgctatttgccctgaatgccgacgtcgatttggtggcagtcaacgccgtcgatgagtcgcatggtgcgggaaaaagaacgctcatacatggatgcatggctattgacctgccgccctaccggtacacctatgggcctatcaagtaccacgagagccgtctaagcaaggagtaccgactccggcgctggccccggcatgatctgcttggagcccgtgtgccagggacaactcgactgcgtccgcaatggcgaaacatactccgcttgaaggatctgccatggcttaatgaccatcgcgtgcctcctcacgttctgcatcccggagcggcgcatattgtgatggccatgctcgcagcagagcaagcctatgcggaattccccgatgcgttacctgttgctggcttgactctccggaacgtctcgatcaagaagaccctggttgtcccgcaagatgacaaggggattgagatcgtgctcagcatggagctcgaggatggtgccaccgccgcatctcctggatgggcaagcttttccatcgcttcggtcgttaacgactccgagcagtggacggaacactgctcaggtctagtcaaggttgatgtcgttgcctttaacgcgcctgcggccattgatacaactaccatggatggacgcgctgtagatgcgcaggcctggtacactcgctttgctgacatgggactccagtttgggccctcgttccaagggtattccgatatctgggctgacccgttcagcaacgtggcattggccaagctatcgctaaacaccactgcaggattgttccctggaggcgagtccaggtatcccatccaccccgcctccttggatcttgttatccgcctgggactcatggcatgtaatggcggccaggcagaaacggccagtgtccagctgcctatccatttcgatcagatgcggttcaaacttggctgcctccaaggccgtgactggatcacaggggtatcgcgcggcgagctacgtgggttgcgtggagcgtacgcccaactgcaactgttggatgactccggcgaggctatcttggacgtggacaacatgcgtttcaccagcctgaacaatgagcagcagtcctctgcacaggatttttctggccaagcttattccagtcctttcgcgcgtcttgtctggaggcctgatagtcgcacattgagtcgggatcagtggaacaaacttcttgcgtctgtggacgggaccacgactttctctcggctctcctacctcatcgacctcgtaggccatgccaacccagatcttcgaatcctgcagcttagcgctggcagcgatgaccggaatgctggtcaagcagtgctaaagtcccttgtcggccacaatggcatcaagcgctaccgggaatacgtcgcaacggacacctctgccgagcgactggactccttccgtgagactgtctcagctttccgcgacgtcagatactccgtgctggatatcagccaagatccctcggaacaggaattccaaatagggacctacgacatgatcctctggagcaatgtggaacatggcccggctactgagcaggccctggcaaacgccaagaagctcctccatcccgggggccaccttgtactagtggaccgcatgaatagcagcgaactggcatgggaccaatgccttcggcgagttggattcgactcaggatataagctagtctgtcgcgaaactgatctgcactccaccatcatcctatccaccctgcccgatccggtaccaactaccaagagcggcaaccctgtggtccaccttctacacgggtctcaaggcacttcagcgcttctccatcatctcgcccgggctatggaacagcacggcctatctatccggatcagtcctatggaccaagcaataaacgtactcgctcccaattctcgcgtggtggctttccttgacggagaaaaccttctgtttgccgccgatcaacgccgactgggactattccaacatctagctgcaaacacggcgagcatggtttgggttacctcgtgcggcctagtgaagggccgaaatcccgacggcgcatttgttagcgggcttctacgtaccttgggaactgagaatcccgcagggcagttcttgtcagtcgacgttgatgcggaagactttcaggttcctggcctggagatggacgagctggtccgctgcttggtcgaacaggagctcctcctgcagcccaccctcgatgataaaggacctcccgaggtgaatcgggacctggtttggcaagacggctgcatgtggacgagccggatcgtgcctgatgggcagctgcagggatacgcggaggtggctcccaccaggcaggaagttgacgtgtcctcacggccactgagcagccttggacccgtacgagcggcctttgagacacctggtattctcacctccctctatttccgtccgtatacagagctgttgcaacccctgcctcgggattatatcgacgtcaaggtggatgctgtcgggctcaactggaaagacctggggctgtgttccggtcgatttgatgcgaacaacctctccaacgaatactgcggtgttgttacccaggtaggagctgatgttactagattatctattggcgaccgggtttatggaatgggcaagggacactttggcacgcacactcgtgtgcccgcaggtctggcacagaagctggccgcggacgtcaacgccatcgaggcggctactatgccgctggtgtatatgactgcagtttatgccttcgagcatgttactcgcctcaagcctggccacaaggtactgatccaatcggctacaggcggccttggtctggcagccatccagctggcgcggtccaagggggccaccatctacgcgacggcaggcactgcagacaaagtccgtttcctgacagaccacatgggtgttccagcatcgcagatcttctcgtcccgcgacttggccagtctgaaccgcgccactcagcaacatggagggtttgatgtcatccttagcaccgcccagggcgatatgttgtacgagtccgtcaaagccctcgcccccttgggtcatttagtcgacgtgggtcgcctggatgtcactagttcccaaaccatgggcctggaacttttccaaaagagtgctgggtttacctcctttgaccttggcctcgttgtggaacgcgactctgtcctcggggcggagctgatgcagtccgtcgacgcgcacttccgcgctggccacatcggacccattaagccctattccgttgcggacattggctacctggaccaaactctcttgcagttctcgcaaggcacccatattggaaagcgtgtcattacctaccaagacccgtccaccttgctgcgcactctccccacctcatccgcaaccccggcgcgcttcgacccagccgcccgctacatcctcgtcggcgggctgaccggcctcggccgctccatcgtgcggtggatgagcagccgtggtgctcgcgacatggaggtttggtcccgccggggggcaagcaaccttgcccccgaagcacagcgtatgatcactgagctggcagcccaaggcatccgagtccagcccgttgcctgcgacgtaaccaaccgtgacgccgtgctccacaccatgcgatctgcgcatgttgatcccacacgacctgttcgtggtgtcttccactttgccgtatcctaccaggatatctcctttgacaagatgaccgaagcccaattcaaccaaggcatggcggccaaggtcttcggcgtcaagcacctccacgatgccacgacctccatccctctcgacttcttcgctatgacctcctccttgggaactgtctatgccttccctacccagagcacctatctcgctgccaacaactaccttgactactttgcccgctaccgccgccggctcggtctccctgccacgaccgtcgccctaggcttcatcaacgacctgggcccgctaaccaatgaccccgtcaccgtcaacctcttcgtccgcgccaaaggccaaaccatgacgggagctcaggtcgtgcgcatgctcgagccagcctttgtgaatgagcaacccaatgccctctggctcggccataccgatgaccccctctccgcatcccacatagtcactggcatcgacccagccgtcctcgccaagatggcccggtcatcagctgcctccctcgcctcttctaccattcccagatggtaccacgactctcgtgtctccttaatgttgcgtgccctagaagacgcctcgtccgctacctcttctctcagtagctcggacatccatgcctcagacgcatcacctactgcccaactgagacgacaattcgaccactccgttgcgacgctccgtgcgggaggtaaagattccaaggaggatgcatggacggagaccatcaaattcgtgactgaggccatccaggccaccgtggcaggcatgttgtttgtggatgtgggaagcgtgaatcccaacaagacggtggcggagcatggcattgatagtttgctggcggcggagtttcgcaattggttccagggggcgtttgggaggggggtgagtatgttggagttgatggatgcgaggatgagtctagcgttgttggcgaggtcggtagttgagggggcggtgggtgtgtgatatttacccacattgagtactactcttcttagtactctatagactgatatcataaaggaagtagtttatttacaccctcatcttgctaatgtccattacatattatcccaacaagtatacagacgacattcatctactaacaacctccatacctacccccaaaccctctgataatctaccacccccaacatgatccactgcccactgaatatacccccgatacctgccatccaaatgccactgaatcccctcgagaatatgccgcggccacccacaaataaaccaaacatgatccagccgatcaagcggatacaaaaagaacgcaaacagaatcaacgccaccggctccctccgctgcaaatcacccaccactgcgtccggcaactgatacaaccacgcaaagacaagcgggaagagagccattcccattgtaccctgcggatcgggacccatgatggcgtcgaggctgtggcctagtcggtctagtgtttgcagatagattgagagccgtgggtcgtcgatggggatggttgtggtaaggagggcgcggtaagtttctaggtggtgcgggtaatcttctaacttggttttgttttgtgatgcgatatgggagttttcatgttcggtttgaggtgtggtgcgagaagaagaatcatcgccctctccatggatggagaaaacgctcgttggcatatctccgctacatagctcgaatacagaccgcacaccgaggaacaaagacaagtggcctggggtgccatcgctccggaacgcgaggtactcccccggttgagggccacgggcgagacttgagatgaagatgaatattgcggaggcatacatcgcgggactgttgtcgcggtcaaggtgcggtaaggtggctgagacatctcgaatagcaacgttaaagtggcgttcggcttcagtgtatatttctgcttctgtgaaacccatggattgggaccattgctgatcgtctgatcgtcgcacgaggtggaagccggagaaggcgaggaggatgtgcatgacgtagtggtgggaaaaagcgatttgagataattgctgacgggcttttggttgggcgccggttagttcaggggaagtggagaagtggtgaaagaggagcatgtccagggctgtgtattggaaggggcgcttggctaggtcgttgtttgatgggggtgatggttgggttgtgtctggtcctgatgtgagaggtgtgccatggcctcgttttgggggttgaaagttgacggatgaggatgtgtagaaggtgtagctatctgtgctggggccctgtgagggtggtgataccgagtctgattgctgtgattgtggagaggagctggagttagtttggggtttgaaactgtagtcgcactctattgaatggcggaggcagttggtgcagtgtggcttgatctcatcgcactggggatcggttagtatctctcactcattgaagcgcccagagtggagaaggcgtcgggaactgactttaattctacgcctcttacagttcttacatcccagacgggatttgcgatggcttttccgcgatagcgtttgggtgtatggagtgagggaagcgcccattatctcacagtacaggtgctttgattaaggtggatgaggtggagtttggtcactggcacgcctggaaggctagataactagttgaggaatgcggcgtagacaccagcggcatgcttaaattttaaacagagcgaataacgttggttccagaagggcttcagggggcgttggcccactccactgcctttgcagcctgcccggggaaattccggttttacgtcggtggattctcggcaacaactcgtccagtaattgtgggttctgtttcctcttgctacatgcatatctccattccatgcctggtatctgcatagccattgttttctcccttcatgatctgtacatttgtatagcgaataaaaaggtctctgtgatggataccgactgcgggctttatattcccatctcctctcgacgccttttaacctccattttcagactcgggtcaactgccatactaaacccaccatagcgaatctttggtaccgtcccttccaatagcttccagtcgtaccgcagtaggagatagatcaaggcaatcttaacctcattggcggcgaagaagcgtcccggacaagcatgtttgccatgtccaaaagccaaattttccggagccgttgtgaccagctgcgccttggtctgtcgctcagggtcttcgcgcatcttgtagaaccggtacccgtcccaggcagctgcattttcgtaggtgtcatcatcccagagcttgtgggccgataccgcaagcatgccattcttggggatgaccgtcccgtcggagagcttcacttccttgagagctacccggcgcattgaggctgttgacaatttatttagccaaaccagtggaaggtatcaaaacagatgggtttatgctctgctcaccgttgttgattggtttcagcctttggctctcccggataacactatccagcagtttcatgttatacagagcggtctttttccaaccatgctgttggagagtgtcaacaatttccttgcgtaaaggctccaaaatctccggattttgcacgagatgggtcattgtctgagatgtcaggtcggaagttgtgtggatggccgccacggaaaggataagctgcgcgctgacagggtcatagggacgacctttggcggccttctcaaaccattcgatagcatcatcgaacccttgtgattgtttaccctctgcatgaaggtgtttcttaaattgacgcctctcctctagtattggtcccatgactttcctagctactttcacctgggccctaagcttacggcatcggggcaagaaccagtgtacgatgggtcgaatagctgcaggccacatgcgaagctcttccgccgctaagaatccatcagtagtatagtcttgagtgactcgcagccattcttcattccggcacaacttttccccaaggaagacacgggaggaaatgcgggaaataagagccaccatcacagttctcaactggatcgtgtgccattctaatcatgacacacattagcattcctatcgtcgaattggaaagtatgagattgtctaccttcattatctgtcaacagttcacggacggcgacagatgtctcgttggcaaggggctcggtgaccttgtctgccaagatgccgaattgtgagttagtatacagtcatgccaccagtgccgtgaagtccgataactaactcgggtattttgtcaagtcgtttccgataacagcctggacaatccccgagtcttgactaccttcgcggaatccgtcaaatccaggtagattgccatgaaatgcctggcatcttgtcagctactttcacacgagctccggatcaaacataaaacacatgaaagtcggaacacacttcgaatgtccagcgagagaagctcaggcggtcgtcattcctgatctcattcgccatactcggagggagaattgtcactttcccagtgtcggtatgcaagagcactggcgtatttgaatgagttgtaaaccaatcccatagcagtcttcgcgcattggagaagtattcttgctttactctagtagacgtgagctcgaagggcttctttggattcagggccgggtccttgtatctgaagctttgaagtaggagaaacgcgaggcctaaagccagcgatacaaggacgggtactggcatcgaggtataacccagcatgttctccatgcttgcacgcaagggcctaaaaggggtgtctgtaaagaacataacgtagtagtgctaacaaaaaagatgagatagggtagcggcatcaattccaacaacggatgaggatagacgcctatcgatacttacttaaatacttccaaattgtgaggggctttaggcgttgagatggccaggatgtagttgaaacaatgcctcgttagtatgccgcatttcccgcttgatctgcaagaagcgccgtcagggtggaaccccactgattcagcggttatgcattgcatacgggcatagcaggaagtgtctcgtcatccattaggatcattcatcatttaccatgaataagagagtttgtgcactggcattgaacgcattgatgcgccagtatgtttgatctgtcggtctcgactccaatgcaggacattatttatccgagacataatactcgtagtagacgatgcatcgaataatcgatatgcctctgaagtggtaagcacaggatgaaagcaactgctaagtttaggtgaaatttccatccctaagatagtgttgttcacaaggaacaagactcgcaatatgaaccacaaccacacataattgaacagaagctgttactcctgtggatagctgcattgagttactctacctgagttgcggggaatgtcaaatcagccctaactgattggccgcgtgtttttggttccttgtccagcccacgcagagtcgtcatcactatccacttccaatcgaaaacgactgagcccaaccacaagagaatatcagtatgcttcggttcaaatcgtcccttctgcataagatatacgcgtagacgtttgaactagtctaaatctggtataggcttcatgcatgaattgtccccacgtaaacttcctatcccgaggacataagcaatgattcagcgcttccgagacgcctgcagtcggtgcatcagcccactcattgctgggaagccaccttgtctgttaaccgcatgactggcttggtataaatcctttgactttcatttgaaggtatcaggttgacgtcaaggatcatttaacctagtgcccggttttggatttgacacctttcagatccaagcaaacttgacatttgggtaagtttcattggccaaagaacagcccattccatctcagtccatctgactttgttagccagatgatatgtaacatcatgcttggcgatgaaagagtcatacgggtgttttggtcgaaaagctcgtctccaccgtcatccaccgaagtttggacaaaatgattcacgtcgttctatattgccgagctaacacatttgtcccagttcttggtgtctattttgtcttagcgcaccttaagtgggttttctattgtttctgatgccccagtcctatcgggataccatagggaccccaaagtacatacaagatctactaagtatacagtacattagagcaggcggtatttactgcgaaggattgaaacagagtatcctagtttcagtttagagaccgtgcactcagcgacacaatagaacatggttttctatgtgcaagtgttagttgtttctggacacaccctcctcgtttacttgcaatcatctacaaatcatgtcccgagtggagagcacaataaatccatatcattctataaacatcaatgggactcgtctctctatcaaccactccgcctcaactatccatccatgccactgttcttctattcgtactatattcttacccccgcccccctttccccaacactaatccctgcacaattctactcccgcttcgtctctcctgcagcaggcccaagcaacctcgcaacagtcggcagcggccacgcgagctgtgcaaccgagtcccgttgcacttccccggaagtaatcaaatcaatgaccgccacggcgatatatccaccaatggcagtgaagacatgccaccttgtatgacttgttagccaagttcaagtttatcccggaccatggggaaagatctacataccagccatgcagctcaagcaagaacgccacgggtagcccgaccgcgtgtctggctacgatcaaggattgacacacaaactcgtcaatcagccagacgagatatccgaagatgaagcttgctgcatacatgttagaattaactacattctcatctcattcacctagtaggtaagccaataataagagtgtagataacataccacatccaaacagcgccacggactgaatccttttacgggcctcaacgtccgggatctcgcgaggaatgatcttgagcgtgcgagtcgtgatcagacacactgcggccccgaatgtcacggcgtgaagcaggaactcatccatgaccatgtggacgaccatgacgatcgtgaacagtacagagagaatgattcctactgtctttgtgtactgaggggtggcctggaaagatagaatgcggtagaggagtggtgtagtcaagaggtgcatggaaagttcatccgctgttgagacggatcagctcagatcacgataattatcattccgagtaagctgaagaatagagggaggcagtacacatctgggtgtgatatttcagagtcatatggtaaccggcagagcaaacaccgacgccaatcaatccgcagtatgtgattgagcgtggcccggtttggcgtctgctgtggagctgccagagaccgtagatgccatatagaactagagaagagtgttaatttgtggactactgtaaggggggaataaacgcactatagacaaagctgctaagagtattaataaactccgcaacatatcgcgtaattacatagtcctagaggacaaatcagcgattattgttgtgggccaagaaaagaccagattgcgcttgctgtagacggacctcttcacagaagctgtcgacattggttagtctccgacgtatacttcaattggctattaattaattgacatacttcaaataagaggtcggggcaccccagaaaggcgaaatcgcggaagccattgtcgcgagcgttcctggcgatcaatatgggggagttgggaatgagaaagaatggggagattggcagacgggctggaataataataaatcggctccttcgggaactccaccgcgacggtgacccactcgtgtctcccgtgcttagcaggccttgttcctgcacggtttccggggttgaagacaattacagttttgcatacgggatgatgtagccaattttgaacctatatccccacttgatcccgtcaaccaagtgcctaagagggtgaagtcattacaggcacctggaatacattttggaccgcctgatgggcttacccgaccgttccggacggggctggctcggcttctatccccagtcttggcattggcgttgaacaaggtatgaatctcctggacaatttcaaagttgctcaaaaacgatgttttgcttgtataaactaagccaatttagtctcaaaggcgatactcgctctcttcaaagttcaattctgcgatgcaggtattagcccctagcatatccgacttgccctgtggatataatagtttgctgcctgaggcctcgcaatctacacaaacaacgcgtcaacacctccttcttgcgaatggttcaacagaattcgaggctcctcaacggctagtccgcgtttgaaaggttcctacgtttataatattgcgtctctcaagaaaagaccccgattccccatcatttcgcatatttataagtagccacaaaacttagatgtaggatatgatggtcacataacactcacccatgcagctgaatgtcgtcacatgtgtaacaactatttccctcaatatttccacactccacagatttaaacccactcataccacggcaaaccatctcgaagaacctcataatctgtccctgagtcaaattgcgggccctccgcatctaggaaatatccacgcgcacactcgttaaactggacccgcgtcgtctgctccacctcatagaaatgatcgtagtgcacatccaacgcgtctttcaacgtcataacctccccacgcggatgcaaggcgtcccatggcttgacgcatacttgggccttgcaggacttgagcacgagaagaagggagtcgagtcgctgaacgactttggaaagatcaacgtttaagatggtgtgagaggtcgcactgggttgttcaattgcggaaaggagattatgaagttgatgagggtcagtctgtctctttggtcagatttcccaagagaaatgggtttgggaggggccaatacagtcatatcatagagttcatgctcattgttacaccaaacggaatagtaaagattatatccaattcccttgatgcggagggctttgtatgtgttgttgtatgccgataggtcaactttcattatcaagattagctcagccatggtcaaagagtggggtgtaggagtagagtacgcacagtcgtatataccctcgcccgccgcatatctccaatattcaaccgtgacatgttcctgtctctcttcttgggccctctcgatctggctcctcgtcaacgaaatagggttgccatcgaagtcctctcgaaggggaatacccagcagctcgagaaaagtgggagcaagatccgtatgcgtggtgacaatatccgtagatacattctgcgcgatatcgggaccacgaataatcaaaggaacattgatgtcttcctcgtatccacacgacttgcctggctgaagtcggtgttgaccaatgtggtatccattgtcactactatagactatatatgtattgtcaaggatattgtattccttcaaacgtgtaaataagccatcaaccagctcgtcaacggcctggagggtgcgtagacgctggcggtaaaaatgatcgttgtagtcaacattagtatcgttttgtcgcttgagagtcttaatccagttggcgcctgaagggatttccggattgaaggagggggtgcggggaactttgacatctgggaataggtgctcgtgtcgcttcgcggggataggtgcgctgaagctgaatttagggttggcgtctaagccagttccattcatgaaaacgttgcaatgcggtgcaattggagcaaccgtgagaaagaagggcttttgggccgtgactgcttcgttgaggaggcgatatgccttttgtgcgaggacatcagtgctgtattcgccttcgtagctttggggtatttcgtggtctcgttggaaggtactgttaaggtagtcgtatgtgaatggatcgaggaggaagtcctacatgacagattagagtgccgactgaatagaaagtctgctggatgactcacgttgccggtgaacccagctgggaagggggcgttgtagttgtcgaccgtgtggacgttgaacagtttaccagtgtagtaggtgttgtaccccgcttcctgcagccaaacagggagataattgtcatttagaccttgagagatgaattttggatagccgcctgaaagcgtatgagaatatcccccgatataagtgacgatgtgtagtacactcaccatgcggaggattgacatccgtgacgttcgtattgtgggccagctttcccgtccaaagggtcacacgcgatggacaacagacactggttgtacagtaatgactgcgatagtgtgttcctttgtctaggaggtgcttttgtacataaggcatgtaatccaaagaggcgagatgggcgtcttgatcatcggttaatatgaagacgacgttgggcttggcggtcgcagaaagcggctgttgctgcttctgctgccctagcgatttcgtagtaagcccagccagggctaacagatacaccagacttcgcatattgctagtatagtatgagtttgcgggcttcaatttcaaagcagatgaacggctgacgcagtgaggttcaaggtaattgcttaataaccccgcgcataacgcaatctgggtcaaagcgggccaaacacaactagttaccttgcaggatgcccagagcatgaaagtgtgatatagagaatattctttcaagacattgttattatctgaccgcgtgctgaagcacgatcgtcatacctcatgccaatgaaaactttcgtcaacacttcatttaagcatttcggatagtgcttgacttagtacttacttagtactagcaagtcgtggcggatgtatcgaggttgagaaaaatatatcatggatgatctggcaaaataaatggcagccctgcactgcggactattgcccgcgacaactgcacaattcctaacgtgtcagaaaaatggaacaacaggaatggaatcattgttatggctcgattgaaagagataatgattagaatacaaaagtagcgagtacattactgcggaatgagtacttacaagtactactatgtgggcgtcaccgcagcgaccattttctgccgcgctctgaagggcggacaggattagctttgtctgccacggctccatttgcggacgatgggccactgcggggcgtcttcagattcattcaagcggccagtttcaacaactcggtcccatagctcagttggttagagcgtgacgctaataacgtcaaagtcgagggttcgagcccctctgggaccatctcttttttgcttttgactattcttcacatctttttgctccagcaagcttttgccgctggcaaatcaaatgacatgctcgttggttggcattggttggtgctgactaaaagccaaatactccctttgtcagtgtcatttttttttgtttactatcacagtaaaacacctatacaagcaaccactgatatagggcatcctccacttaaagtaacgttaaaaatatgtgcggctagcctggaggagcaagctggaaagggccacttaaggagccgtcttcattgtgatgtttcctttggttttagcaagcccgagtacaggttttgttcatgacgcaaaactagcgagagcctggcaatcttaatctggtactgcgcgtatgtttgttggcgcaagctttcaaggaagtctggacacgtcctcaacaaagcagatggaatggagtaaggttagtgaatggttccatttgcatgctgccggagaagctcttgacggttcgtgggatgataggcaggatacaacatattctaaggaaacagtcaggaaggtgtccagatggactttatcagggcatttaaacaccccttggatacgcaaatgctccagatcttcaggcagaatatgtcttagctgcagaaaattaaaagaaatcgggctggtgctcctttgccgagaaggaggtcccggataatacagatttagtcgggccttactcaaatcgcccagtaccatagccaaaggaaaggattctccaaggtaaaaaaaatccagtattcatcaattacattccgtactatctttgtggctattcaggaagtggtcgaacatggcagaacaggagatacctctataaaatatagtaatatttatccaagcctccagagggctgttagaacggtgaatcggcaagtccagcactattcagcggaagagaataatccctgattgacattggttaacacagtaagtatagtgcatttccaaaactgaggatttgacgctgctgcagtagttgtctggtgggatatgggagtctggacgggggcgacagtagcggcgtgttgcatgaagtgaccgtggtggtcgacattgcgaggacgtagctttcgggtatatgtgccccgcctgatcttgcggggactgcaataaatttatcactctaagcgcaatttataaagggaattcgatgctgagcatcacatctgatgcgcttctagttacatcacctacatgccttgcccgctcaaactcgcggctgagctggctttctcgtataattctgcgctttgggcattcgtggaagagtttcggtaaagttgcgaccgtagactctcaagtgtccatcagtcttcgcaggatgatctgggcaggagaacattgaacaacgaagagcaggcaaacagtgggagagaatatcatgtctggtttatatacactattggacatatagatgaggggatggttgcataaagcctgttatatagtaagctagcaacagtcacttaactaactagggagcgcttactgcccttacaaggttgaaaatttcatcgtgcctaaagcgccagaggaacccagctgaagttttagaagaaaggcgcaacactttgttcgggagggtagtcctcaaaaaaaaaaaaaaaaaaaaaaaaaggaatacaatactaatgactccgtctacaatgagccagggggtaatctcttttgttgcggagaagcggggacgaccgaatgcagtgaacaagagcgacgctaaccaatttttccctagggtctgatctgaaccaagcagttagatctgaagtattagccaggtgctgatctcttgggtaatgggccgtaagatgtatctatacccagctattctctctggcttctctggtttccccttacgttttcctcatcctgcgaattcatctttcattggacatcaccgtaaaatccttctgtattgtaccaacagccttcttcctagcgccacacagcagcactcgtaggttcagaccttcccatttcccggataatacccagtggatctgctggacgagccggttgatttgtaatccaccgcatgaggaacttccctggcgatatcctcctagagcataagcctggtcttcctctatgtcgcgtcgggctgttctctttccattaatgtgattcagaggacatacaccttatatattcttccagaagggcatatccgtgcttgctcaactgaccatgaccagcaagtctgccgggctctccgcagccgaaccgatatttccacaaattccacgtgtcgccctagtcccgcaagacgatgcctcgtccccattgtcaagtctggagttgcattccattgaaccgataggggccaatacgccgcatagtaggcgcacaaggcatgccgggtcaacaaaaccctccgaagtcgacgagatgttcaacgtcgtgcagtcagcagcagcagagaactatggagctcaagacacaaataggaaaacagcctcgatacacccgcgcaggaacacgatctggcgactagctagcgcgtgcctgatgaactttggcaacggaatgaacgacagtgcacccggtgccctaatcccttatattgaggatgattacgggattggctacgccatcatctcactgatcttcatcgccaacgccgtcggattcgttcttgccgcgccccttactcacacaatccaagcccgaatcggccacgccaaaagctatgctctctcgatgagtctcgtcacagcgggctacgttgccatcgtatgccacccgccctttccggtcgttgtcacggcgtttctcctcctcggcttcgggatggcgttaagcatcgcgcttaacaatgtcttctgcgcaaacctaaacagctatgccacagcactgggctttttctccggtgcgtatggcatcggtggggtgatctccccactattggccacggccatggtgtcacacggcatccgctggacatacttctacttcatcacactggtgatttcgacgttgaatatgttgcttgcggctgtcgtctttcgcaattataaggacgaaggtgccgcttcgagggcgcccactcagcaaacatccccctcccttgcttctcagacggcccagccaaacgagaatgattcccataactcccacactcgcctccaaaccctgaaacgagccatccggaatctcacaacgatcctaggatcactctttatcttcgcataccaaggagccgaagtctctatttccggctggatcgtctcattcctcatcaactaccgaggaggtgattcgcgacgtgtcggctacgtgagcgctggcttctgggccggaattaccctcgggcgcttcctccttgtatacccggcaaaccgaattggtgaggagcttgccgtaggactgctggttgtcggagcgatagcgttccagctcatgacttggctgatccccaacattgtcggcgaagcggtggcggtggcggtcgtgggcttgctgctagggcccatgtatccatgctcgacggccgtgtttgcgaaactactaccccggagcattcagctgactagcatgagcttcatcactgcgctgggaagtagcgggggtgcagtatttccctttctgacgggtattctgtcacaagaggtgggaacgatagtcctgcatccaatttgtttggcgctctatgcagcgatggttgtttgttggtgctttttgcctgcgatttcgaagagatcggagtagggtcgttcgctataagtttcgtactgaatgtgatcaatttcatataactagaaataatggtgtttcacattgataggtcggatgatagcagacctctgtagtgtaaagaaggctgtgtcagaatacctcagcacattatacaaaactaaaactatataggagttgtgcggatgatcctgctgttaccagtaatgttacagagtagaagataatgcactgggtagctaaaactgtttagtcagaattagcaactactgttctaaacagttcaatgaccagcatgttctggacattgtggtgctgagcaattttggtcgctcgcgataggcatgcccagggctctggaaaatgatgaatcattgtcacatgaacctccacagcctgtgacaatcggcgccgtgcttaccgtaaaagtggacgtggagtggttcatcaaatcgcagagagttcctcagagtgagcatgcacgtttggaaattcttggctttcccttggccccattcatcaaccaatctcggaaaatacactgcggcacttggaaaccactagacagaccttttcggccgataggacctggatgtggaccgagggaaccttgtcttgccagtaacagccataacttactagtagttagccgcgtttccttcccaccgtgagccgtggcaagccgcttgcgtatttctgatagccactcagtaatgatcagccttacgcttttgtctgcctcttagtttctagtcggatttctcactcggagttttgcaacacacactgtgtatgcgggccgccatttccacagccgagccgagtcctaccgacagtggtggatggttccaacctttagggcttcgaatagttgcagcacttctctcccagataacatatttaatgtcataaggttccactggtgactttgtcggcgcgtgtatctgtctaggtcatatgaagccgcgtagttcacagcatagactgttaatcttgccttatgagcttagaaaccgaagcgatggtgcttctatcttagagttttcgtggggcataaaaggccccatgagcgcaccagcatcatctgctggctacgccctgtgctgggataaaaattacccaaactagaaggtatactcatttaagttacaaatattggtattatgcacattatcacggaagcctagagcttccacttccaggtaagatggccactaacacggtcgaatccctgttccattcgtgcccaggcaaccgtcatggtagatgccaccatcaacgcactgacaaagatagccatatccaaatagctacgcgaggtagtctcgccattgtacgtgcgtaccatgactccagccaccggggtgcccaccaacccagccgctccctgcaccatgtacatgatacccgtgatacggggcatctcctgcaaaccaaagagttccacgagagccggcgagaacagcccaatataggcactagcgaagagaccgtagaaaatggtgaaaacaatgaagcagcccttggccgccaccaggtcatgcaacgtggacccaagcaaggtactggggatccagagtgccaccgcacccacagttctgtcttttttgttgcccgaaaactatttgaatgactgaaacctcggcctttcacgaaaagactgagagatccaactgcaatacagtatattactgtcattttctgggcctatgtgccacggttgccgtcggccatctgattttgcctcattgttccaggcggggaagtggagaagggatgcggtccctgaaaattacacactcgacagtttttgcaggtggcgcttttggattcgcaacgctataccatatctggttagcctcgttcaggtactcccgaaagggctaggctcggtagtgaatcgccgacttggcagtttgggattgttaccatttcttctccgctaactatctatagctagtctaatgagagtaaaggtgcaacccggtctgcaaccactcggagctcggacagaattgctggtcttagatactctagagtcatgtacctgatatgatacctggttggaccttccatatccagtcggtaaaatatggggtcatgtggcaagtgggaagaacttttccggtagagttccgtaacattccataccctggatcgcattgtaacctcaagtcgcaatagtcaccctcttggtaatccgtttaacccctagggctagagacagtcaagcagagccgtccacactaagatttgagtcactcgacatcatcttctcacttcccagttcctctaagcatcccaattcattccagcatcttcctttctctctgtcctcaccagctccaacataccacaaaatgtcactcataccaagcgttgacagtgctctcgacgcaattggaaacacaccatgtgttcaattgacccgcgtagtacctcaggactgcgctcgagtgttcataaagctagaaagcttgaatcctaccggctcgtacaaggaccgcatggctctctctgtcatcgaggaagcggagcgtcgtaatgaccttcgtccgggaatgacagtcgtggaagccaccggcggcagcaccgggtcgtccctcgccttcgtctgcgccgtcaagggctacaccttccgtgtagtctcctccgatgcctttgcgaaggagaagcttaacaccatgactgcgtttggggcgcacctggacatcgtgccgagtgagaatgggaaaatcacaccgcaactgattccctctatgcgagagcgagcacgccgtattgccacagaggataaagatccttcttcttattactacgccgaccaatttagcaatccagatgtctttccaggttatgaaacccttggtcgtgagatactagcacaggttggagaacctattgacgccttttgtggcgcggttgggggcgcagggatggtgatgggtgtcgggaaaactctgaagcagagctggccggcgtgccatgtagctgtgcttgagcctgcttcggcgcctgccttgactaagggccatggcggcgagcactcggtggaaggaatcggtattggattccctcctcctctactgaacaaagactggtatgacgaggcacgggcgattgatgagagggaagggcgttccatgtgtcgacgactagcgagggaggagggtcttttggttggcacttcttcgggtcttaatgtggtcgccgcgatacagttggctaaggaactgggtcctgggaaaacagtggtgactgtggggtgtgatactggtctgaagtatgttcgaggaaacctgtacacagatagctgaaagtgatcaccgggccgagacttgtgtcaagaatgcaatttccttctactgacgtttccattacacttatccaactggtcagggcttcataaaccaaacatgaaagttgttgcaaattttgaaacaaaaccttaactcgtggttctacaagttcatgttaccatcatgctgtcgacaacaaaagagctgggagtagaattacaaagtatactagttaagatcagaacccatcgaacctcgacacatagataacaggccgtcttcttcctctcccccatctccactctcctccattcaacttgcccgcacggccaataactactcgctctttgaataaagcgcctcccgtgcgttccttcccatggaagaatagatcccgtatagcctggctgttataagattggaattttggttccccgccatgatcatctaccggctgcgaaacggcaaccacatccttccctgccattttccgcacattgatcaacttgattaccgctagggcttggtaaattgggaacccgccttcttctgttggtagggtgtcggccaagctctgtacaaaattctcgatctcgatggcaagggaaacagacgtggtgcggaggagggcggtgagaagaaggtttgtgaatccgattgtgtatatgttttgcttgaggtgatgggctggcggcgaggctttagcaatgcggaggagtagcccaacgtaggggtctgctgtttggccttcccttgttgcaatagtagggcatgttggaggaagggtgcagaaaatagtctggcattgtaggatacaactggtgaggtaataagcgtagtttagcgcggcgtcgtgggaggtgaagcgcagtggagtggtaatatctcctgttgaggctgaatccatcaatggctgttcggcgggtgagaggtgctggatccagcgatctagacgctggacttggtgggcgaggagcacgtggaaatgcaatgcatcagtgccgggtgcgtctgatggttcaggaattacggtctctgtgctttgttcacaatcccagtgtcggagtatgcaagagttactcagataatgcgagtcacacattatactcataatctcgacacggcgctcatgcaaggactttggctgcccttggaggatgcgtggcagagggatcgatggcagaagccgctgcagctttaccgagctaaagtaggagcgcatccaccaaaccgaaagccggctttgcatccatgtggttagaagaccccgaactgtctcatcttgagcatagtcattcagatttgtgagaaagcgaaagagcccatccgtatgacagtaaaaggccgtaaaattagacattgaagactccatatacgaaaggataacaataacggctaacacagttatcgctacccgctggtcatgaagttgatccgagttgacaagtctgcttattgcagctgaatagtaaagctgacttctggtctgatggattaagttgggtctgaacttccccatgtggaagctctctgagcgcattctgacttctgggttgaggcggctgagattacaagctgacagggctagcattgtgttcttcaacatcacgtttgctgctgctgactgggtaaagaagcggaggatgggatgcagagttggcaggcactgatcttcccaatacgtaaggtagaaaacgtcccgttctgtatgttgtagcgaccttatcagatccatactgccgcaagaaacgccctcaggttctacgtgacttagccctaggcgtgtatgagagcggtctttccctctcagcctctttggcattcgaggatctgaggaagtcacaacacggaattgcaaatcctcagaaaagcgctcgcatgttttgcctaacctggcgcaagtcccacacgtgggctgtttttcatcacactagccttatgtcagtcttcagaacagccaagtcaaacatacccagggggaagtactttggttcgcctctgcctacaactcttgcacccattgcgtgaccggataatatcggttttcttgggtctaggtctgacagggagatacattgtatatactaccagggaatctccattcgaaaggatcgaatacggtaagataatggaatgtgtcgtctgactctataaaatttgtccatgaggggggaggggtggcaagtcacgtgatggttatcaagcacctccatggatctaggccttggggctgcaaattcacaacctcaacacaatggcaataattggggagattaagcctagaatggcttttttttatgggagactccgattataaagctatgatttaactagatactcgccttaaaaatgtataattcgagcatcactatcacctatactacttacaggcttgatcgctcgctaccgatgtaattattataccctataaggtgttacagaacaattgagcctattagaagttgttgttacatcaaacaagcagcttgtccatggcttttgactgggtgacgggaaggaaaatcgtgtagcttccttggtgtggccatgtttagtatgacgcgtatgaaccaagccagacatgattcaggtcgaaggtaaccacgacgctccggaaactcaaagatgcacatccctctttttgtccatctatggagagtattgtacattggcctaatgtcgtacggtctatcgaacaaactgtgcgtccctctatcaatatacaagaaaaaaacagaatttggaaagggatcacaaggctaagcatcggcggctagaggcacactgcattctatccgtaatgtggctgataggcactctcattagcttgctttatgacattcctgcaggtgtcggagcatggcggcacaccattttttcagtagagagatggatgataaagttgtccatccttaggtaaccccaggtatgggctattgaagatcaagaagacggttgcaacagatagttaagcatagtgttggcctccagtagacaattacacacaagaaatttgctaaaaagatttcatcgactaaaaacaaattcactgggcttgttaacatttttgaagtcagtaaacgatgcatcgtgaagatacctcacctctaaacgtctccaggtagtgtacctagcaactctgcagcactgatagagtttccatggcgagttccccaacgttaacccctgtaggaaaatcattcagggaaccatatccataaatagcgcgactctgctgcgagtatggtctcagaagtagcagaggcgtaccaagttgtaattctatactagttatgagagagccccccatcagtccataactataatggctgctttatgccagtcattatcattcctgtgacccttatgttattccatgtcacccagcctacagaatactcaccagcagcatatagttaggcaatacacatagacaggtgtataggatcaggaaacttgatgccttacgcaataaaaagacgataagagggtgggtttattgggcctgtagtccaagcagtcctcatttatcgggcaggcacaaggttgcataagacgtgaaactttcaacccacgatgacggcaattttcaacgcatagttgcacgtttgtttgtttgctgatggatgcaatgacattccggggactacgggaggccaaagtcatccgtcaagtgggcataatgctttttaggtgcgagaaacccgaattgagcagtatctggcagggccaaagcttcacctcgttgggaaggagctttcccggatagggtgggtgggaacgatgctaacggaatctagttagcatacgataatatgctgatcatggtatcgggcaaatgcggttttgaagttgtgatacagccaataaacacaagcatataaacatagggctctgcttactattcagattttcagtaatcactgtaggccgaaatttacctaatttggtttaagatacattcatcacatagtacccgtatgaaaaatacgacatcaagatcgggcaaattgaacggccatgaatttcgagcataaaccgtaaagcctggcaggctctacgcagtgatagtaagaagagcagttcttaattgcaagaaattgcaagagcaaacaccaaatctttcgtttgactacttattacaaataccaagcttcgcttgtttcaagtatcataaatgtgtagtatacatacaacctactatataaaggtaactacaataaccttgatctaacatagaagtagtgaattatcaatcattctatatatccctcagaatataggcagttaaggaacctttagtccttgcgtttcccttatggcaactctatcacctgccgtgattgatgcggtggttgagaattccaatggtgacgtaacatttcccccttcccgtcgttttaccgcccgccattcacaggctttctcttagcgagtctgcaatttaagtgcgaggagactttaatgatcatacctgcgtagagatgaattgagttggggctgacgctgttagcgattgtggtatctacttctacgaggtgttaatatttgcctactgtcgctagcccgtagtatcggtagtatgtacgtacatgtatcaacaatgtggcaaatccaaagtgaagtctatttaatcacttatttcgcatgtcttttgccagtacaggttgtcgtaatggaaggtttagagaatgattcgactaccaaacgcctgccttcgaagcaagcacattatttggcatcgggcatatacacactcatctcaaagccattagtaaaaggcagagtcatgttccggaacccgttctccgggtttcgcatgtatgccagcaagtcagcataccccttggcaccggaaatagtattatcggtgagaacaactgcaccataacgaaggtgaggctggactatcttaagggttggaagagagagtgcagaccagactatacaggagccacatgttagctcggagcttacctctaaacatcccaaatgacataaagcgtagacttactatccagaagtaaaaggtcaacctgcggcaatccttgtgcaagcgtctcgagcaggtttccctctctcaagtcaatctgatcagttactacagcaccacattctgcccagtacttccgtgcaatctcagctttctccttttccttctcagtggcaataacaaccccctccttccctgtagcagcctttgtcttcgcaacagcaagcgccaagtaaatggtactaacgccaaagctcgtcccggcttcaacaacattcaaggctcccatggcattgatgagttgatagacaaactggcacttgtcctcgtcgagagcgatgaatttgtccagcatgagctgatcgaaagcatctctggggttctgctccagggatttatcttcgaggtcgccgaggacatcagcggagaatactttccctttgtcggtgcgggagatggcggcttcttgctcgagggagatgcgatggagtctggagaggaggtcgaggatgtgtgcgggggcgtcgacgggggaagaagacatagtgagaatgaatgtgtgaagaggcgaatgttaatatttacggcttggcctgttgatgaatagcggttgtagttatgctgcagttaggtaggtggcaactacccaacaagtagtggatcggacagcatcttaaataccccgatggggcttgtcaacgggtgtggtgtcgcgggaaggcgcaacagatacactgggtcaaatgattcaatgaagctttcaaattacccatatacttacagcacagtattactattacaagtgagacaaattcagaaataccgagtacacatgacataatggggcacagtcgtatgggtctgcttactaacttcggagttttgcgaatactccgcgtgaaggcaaagtggagatttggtctcggctgtagccggcatttaggttgtttagttttccgtctttatactccttcccctttcctccatacatcatggtaatccaattcgatggagagaaaagcgttattgatatacatgcggacggtcatatcttacacaagaatttatattctttttctcaaactttggacattccagaactaagttcaaccgtgccgggcttgcttatgtgcgtgcactcgtcacggattcggaccatttgcctacgtaggacgaacaaacaaagcgaggcagccacatacagtgcactggtgaaaattaggaaatgtacgggtcaacatggtcaaaccgtgagagtcgggaagcgcattgcgtttctattgggtggctgcctcctaacatacagctgactttgcagtgacggagtcgctaatcccgaaatgagaggggaagaagaatcctgttccgtgcaacctggtaataagcgattcttgtctgatccagttaatacttcatagcccctcagctgcagcgagatcctgcggcgaacgtcctgatccctcttcaatagtaatttccatttcctgctggccacagtggacgtgtgaactgtccacgagggccatgatcaagattactgtagctaagtagttgtaggcttcgttttctgcacttttgcacattcatccttccctaccgtcccagtagtcccatcattccgagaccgtcggtggcatcaatcttgcatcataatttgtaccatgccaatatccggtctatttctgctgctctgctttcattacataacgctccagcgatatctccacaagggggcgggcagtcacggaatggtcaaagatttcgtcaaaacttctttgggagtagaatgatgcttgttaactctaatccgccttgcatctcccacaattccaatacttgccacaaacttaggattgtctgctacacaaagtgtgcgcttcaccagcacgtcagtaaatacttgtcagaacagttctctaccgacctgaaaacaagtctgaaaggaaagatgaagatcctggtgatgcatggtaagcttcgcatctcccaaagaaatctcgtacctgacctgatggttacaggggcgcagcaggcggtaaatgacttccgaatagaagcccctgggctagaaagctcattaagccagctctgggacctgacagtatcgaaaatctctatccaaccggttctttcgagtgtgcttcggaagattgcctcatcaacaatagcgagaattgcagaaaatactgctggtggggagccgacaacgttgatggagtgtatccgagattgcgggatggtatagaggctgtactctctaccatcgaggaccttggtttatttgttggaatagtcggttttagtcagggtggcgcaatggccgggatggtcgcatcgctactcgaaagaaatcgcagtcttttgctcacttccaggctgaaggcgggatgccatatcctgacgcatccacctcactaaaacaccctccgctcaagttcatagtctggttttctgggtacgcctcatcgcatcctatgtaccgcggcttttatgagcacaacattgttacttcctctcttcatgttctcgaatgctcggaccctgaggtgagcaaagaggcatcgtggagactcgttgagagctgtcggtcgtgtgtgggatctgagccggtggttgtctggcatcctgggggtcattttgtaccgaaaagcgagcgcgagcttgaaccagttgcaaaattcattgcttccaaggcttactagccttgggcaatttgcttatgattctcctcggtcagtttgatgggttgcgaggctaagcgccagagtctgcatccattacgagggatcacccgccagctttcgctatggtcaacatcatttgttcatggcttctgtgtgcgagtgtctcaccaagtcaatatgtaggctgcggaatactccctccaggtttgaatcgagggcttctgttccattcctatttataaactcctttcggtctccaatacaatcttactcgatattgcataagattgttgttctattgcaacccaatccattaagcgagacctgccttaggaactgcgaacagctgacgtcccatggcttgcccatcagagaggtaaacatacaagtatcaatagtaaaactgtcagacattattatacattttgaatatgtaaaacttatccagtctggctcccaccagctattacaaattataatcatttagatgatcttataatacaaagacagggcttacaacctgttcagacagctgcaagtatagaaacaagaaatatagagaaaaatatatactatattactatttagaggttccgtagtgagaggcgtgtgaagacgcgtctagtgtagtgccagctaactgtgcgaccaagcctactacatagtagtatgactgccttaacagtgcatatagttcgcacaagaccgagaccatgctactagtaaagacctttgagccacacatacacacacagacagctcttttcctggaccttcttctgcaccacaatgacccaacaatgcccctaatggtcgccagtttccattcctccctcattaaaataagctaattaattaagcttgatccccaacaactgtgccccaacagcaacctccacgccatcaacatcaacaccaacaccactcccaccacccgtggtaacatacaaccaatccatctctccctcacccctgccaaacgcacaccccgtcggctccgcaatctccgtagaatccaaactgcccgcaataacactcgtcagattcctcccgccctgcaaatcaaagctaatctgcataattgtattctctgccgccgtagccgcatatgcaaacttccgtccactcccagcacggaacccatccggggaaacggcgaaatcatcaaacgcaatagcctcggcaataacctctccaggaccagcagtcacattggagtacagcttcgctctgcaaaagtcgccgccggcggtccagtacacgaatccatcttgaaccttgattccattgatgctgctcatcaggttcgcatccttgatggcttcccaggtgcggccggttgttgtgtcgacggcgaagatggaatcttggtacgaggctgaggcgaggataatggtctcgttgaatgcggctagtccgttgaagcctgttggtgcggtgggtcgggcgatgagtttgatgtctggggtgtcggaattggcggtgaagtcgacgcgccagatgtgcgtggcgttcttgggagggtcggagatgttgtcactggtggtgttggcgccggtaacgtagaagacgtcgtgggctgcttcggtgatgccggagagaccgagaacgctgggaaaggtgtggatgacgttcttctttgggcttgaggagcggggatcgaaggagaggaggctggctgggggaccgatctcggttgcgaggatgaggccgttggatcggacggcaaggttctcgagccaggtgtcgttggaggcgaattggtaaatcgttcgaacgttcagctcggcggagactagggtacttgcactgagagcaagggtgcctaggagggatggatggattttcatgatttggacaagcaactgagcgtagtactaatgagggagaagcattcggaggctgaggaagcgtgtggagaatcagattgaaggagcggacgatctcattagatatagtagacacctctcaattttataggagtatagtataggcgacctccttagctagcgttgaagattatacgtggccctgccctacgcaggtacaatgatctgcttccaagcaggaaggaagtgggcatcttcacgcactccattacgagtcattatctgatcttagatcagttccactgggtatgggggcccgcggaaacagactgggctaatgacgtgagcatggtgcaataggaggattcttaaatatataaaagacccgcagtcctgtcactaggctggatattaaactactctacaaagtctaccgccggtgcagaagctaaagtgtcttcctggcatgctcggtgttgtttcccgcaacaggaattccaagccgatggccactgattagccctcccgtgacaaagcattgctgcaacgaattcggtttctttctctctatctggcctcatttagccgctatctccgaagctattggataatattcgggaaataataagatcttttacggtgggaccgcgaattaccgatatctggacccgcagaagatcgtcaggacagttccccggacgcgagagttgacacagtttaagtcccgtggcgggcttgcggttagccaaagctaattgtttcatttgaaaaatagaagtagaaacgattatatgtgacatgaatatgaggcgccgagcgatgtacgacgaaaagaacactgagcatatggacggacatgcggatagtttcatcctgtcgtgaaaacgggccattagctttgagacattctcatatgccttcaggatattggccactcgctgctccatacctgacgtttgccttccactctcatggtcaagtccaacagacaacagacacccgaggcatggatatcatggcatgcgacaaaatccgtggctcgacggagcgcttcctggtgcaggggcacccacggttacggcagttacagcatggcatactgctatcccacttaacgcgaaggacgctacagccagttgcaggctcctgagacgtggttacgttggggaggccatgatgccaaggtggatgaggatgaggaagagccggaggacacagaccgatcggggacgacatcagaagtgaacaacgtgaagagaagcagcaagtagaaaggtccaccaagaagcttgtgtcaacaatgtcctgctgttgttgctcatgattttcagggcaatcatctttcaagagcaggaaaaaagatagccgtgactccacctccatttcctctaagcgccaccccaccctcagcctcgtcagcctcgtcagtagcgagtctagacaccacttggcccctgattctttgagagtactaagagttcggggaagcgccttccgctggggctaaggaaaaatcatgcgttgaggccgattgattttttccattataggcgcgatatctcccactccatagctgggattccgcccctgacacgaatttcgaagagaaatcaccatgtgatatgttcaaagcccgcagatccttggggaaacacatcagcctgcatttactggtttgagcacatgaaccgggattcacctatccctatacaaatgtcatgcagaaaggcaaacactcaatgttgaaggaataactcctgtatcaatagtcaaaatgtaaccttaaagttactctgcatatggtagaacccaccgggcccgcgtagacctccgcaaaaagaacccgagtcccgccgacgtgtctgtcatacattcgaagcatataaagcccacaccgatacaaggaatcctgcccccattcattcccctgacttcatgcatttaatcagtccgtaagattctctctatataataatatggcaaccccaagcctcatctccatcaacaagctcgccaacacccgtgtcctcataatcggcggcacgtccggcatcggcttctcagtcgcccgtgcagccctggaacacggcgcctatatcatcatctccagctcaaattcccagagagtctcatccaccatctctcgtctccaaactctctatccagacaatgtctacaccgaccacatcaccggcagaccctgtgacctaggcgaccaagccacacacaaacagaaccttctttccctcctcgactacgctacgtcacctttgctcttccccaataccacttctcctgctagaagtaatgatgatactattgagcgagtattactaaaccatataatctacaccgctggtactccacccccacggattcctattgcttcttccgaaaccaccgcctctagtttcttagccttgagcactctccggctacttgccccaatgttgattggtaaacatgcgaagaaatacttggttaatcatcatacctcatccataaccttcacctcagggttaatggcggccagacccgcggcggggttggcggtgggtggtgcggcagtgggttcagcgctcgaaggcttgacaaggggattggcggtggagttggcccctatccgtgtgaacgtggttgcaccgggtgctgtcgagacggagatatttgaaaggttaggacctgcgagagaagcatatatggaggcttttaggagggggacgttgactgggaaggtggggagaccagaggatgttgcagaggcgtatatttggtgtatgaaggatgggttcgtcacgggacaaagacttgggagtgatgggggcgcattgttaaagggggcatagtatattttagctttgaagaaggaaggatggtttcgtcgtataatgtttccagtatggaggtgatttcgggtcatatttctatgagtttctagcgataagcagtaagatagtggcttcagtaatgcgaattataaaatttgttagtgggcatattgagactaaggtacaggtgccagtggcatggcagcatacgtcctcgttcaagaataaagagaaaagaaaaagaaaactaagaacagggacgggcgagattataaggaatagttaggaggaaacatatcccactattcttctgcgtgtcacattccatccattctatctgttcatcttgtggctcgcactaaactcgtccttcacgggcgacatggtcactcattttcttgctcgtcaaattcgcgcagcatgtgtataattttatccttgactatggagtcctttgccgccctaagaaccacatcactttgatgctgatagataagctttagacacttcctacgatattcatactccgtgttgtcgcccgtcaaatcccgcaaacgtgatccttcatctccaggttccaagagctccattactatgaactctaccgccgctttattgatcgggaggctcttctgcaatttgtaaagaaaatttaaattttcgaagcaatttgaatccataatagctgtactaaccgtttccttagaaatcggtaagcctttgtcttgctggtagcgctgcctcacagaatttggtccgtcagtatggttcattactgcagtgaccaccgcctcagaaatcgggaatctctcttgatagtactgctgtagaagatgtacttttttaagtgcatgtggtgataagattgcgttttggattgtacttgcagagatgggtggacagctttgttgcttgaacaaaaactgcaaaagttcggttccgtcggggagttgtactaccgcattcaacagatcttcagagaatggtagagtgtcttggtgttggtaaaacagacgaaggatctcaagtcgatcgttgtacttgactgcagcttcgatgacctcttcagagattggtaggttgtgttggtgttgataaaacagacgaaggatctcaatcccatcaggatagtgcactgcagtttcaactgcctcttcagagatgggtagacacgtttgatgttggtaaaatagacgaaggatctcaattccatcaggatagtgcactgcggtttcaacagcctcctcagagattggtagattgtcttggtgttggtaaaacagacgaaggatctcaatcccgttaggatagtgcactgcagtttcaactgcctcttcagagatgggtagacacgtttgatgttggtagaacaaacgaaggatatcaagtcctttaacatgtcccactacattttggactgcatgttcagagataggtagattgtcttggtgttggtagaacagacaaaggatatcaagtcctttgacatgttccactacattttggactgcatgttcagagattggtagacacgtttgatgttggtagaacagacgaaggatatcaagtccatcaatgtgttctactgcattttgaactgcacgttcagagattggaaggctgttctgatggtagtagtaaaacagtaaaataatatcaagtccaaaggtatgtttcactgcattctcgactgcatgttcagagactggaaggctcttttgatactggtaaaaaagtttgataatcgaatttccttgtggattttgacttgtttcatcgatcacccgttcagtgatgtaagaatcggccgtgcggagaaaaagaatacccatgagctcatagatgcttgttgcatttctgactgaaatttctattattgatgctctcttccgttggtcgtcaagaagaatctttaggagtttatatgcgatgtcataacgtgctgctgctgcctcgagcactctttcactgaccggtatttggacctgagtctgacacaaaagtcgcttcatcggttcgaactgcgcttcaaagtcatcagatttcagtatattcacaataatgtcttctaaaatgagtttcagacatccgtattcctgctcttttccctccaatgtctgtcctaggctgctagaagtagtagaggttggcactttcagactagttaattcactcctgctctctctggcaggtggactgatgtcccaagtgaagaaaaggtcaataggtggcgcatatatgagttggaattgcttccgtaggtctgatatcttcgtcttggagtgtcgacgaaaggattcgtatccggttttctttttgaccatgtctggtgttgccatactcacgacaacactgattttccctttccccagtctaatgattgttggctttggagcattatgcaagaagcacacaatatcatagacctgaattaatgttgctgaagcgtgaattacccatttatttccccactgagtttcaaagaacatccccaaggcattctcatggaagccaataccaatagtctggtagtcatgaaggggtgtgcttctttcgactgacacgatatggcccaaaatccaccctttgcctttgatcacagctatgttagtgtcaggcagaactgccacagtatgatttcccatgaagatatagtttacgatctgcttaacaacagcactgaatgcaagccgatagtttggtcttaagcagggtgttttaagatcatccgagcacaaccctagcaacgcatatatcttgtcgtgtggaactgttgcgaagtgggtatgatacatgtcgatcagctctcctaaagggagattacctggcagttttcgtgagttgcgtggccgaataattgaacttcggacaagagggatgactgtgagcacgtggtctggtagtagtgacagctttagtctgctaaggccttcacagaacgaatagccgttgacctgaactaggccacaccgaaacataattgatcgagcaacaccaacttcttgtagcacctgctgggaattagttgtgcactaacttgtgaaaacgttcaaaccccagcttacccagatacggcgaaaccaatcatgtcttagcagtctcatacaggccacatgatccgcttctgacaaatcaacgctttcggtacctgcataaagcaacactttgttctctgcgagttgatggatcgtgtcaagtgcattggggccagcatggtctggctccccaagccagacaatgactcgatcggcctgtgcgtagatggctctcataagcggaatatgtgtattcttctcatcttcgtcttcttggttgatgcagatcgcatcaacccacaatgttctctccaattggtggtcccgaaggtacgacaatgcagtgtgaagattctcagtcacaggcagaagacttccaccaatcagaactgcttgcggcttatcattgctaccccacgtataggaaagtgcctcgtaaagatggtttcggctttctgacactgaaagatcgtagttgataagtatgcactcgatgggggcatttctttctctttgtggcaagagacggatcatgcgagtgaacgaccctggtggaagtgctgaatatgtatatgctatcatgatgaacgggtcatcatcgggtgctatagtagagtaacagagtggaattggacaggcaaaagagaaagaaaactctggtcagcgcaatgccggccacgggcggggatatgccaacaattagttttctatagaaaaagcaatattcctcatcgcccttgccattgcttggttttcttgctagagtggggtatgcaggcatagctaagatgtggttcgttatgataggctgctaacgttcatgacagatgcactacggagtagcgtacctcacttgtgctgtgaactactctggaccaagagtgcccagcacagcctttgggttttactccgtggacctaggaaatgagacatcaaatcactagatggctcttgtagctcaattggcctatctgagcttaacattcttaggaaacccctctggcagccccctctggagtgcgatctaacttgccacattttcgaagcctgcccagggaccacaccccgtttcacagctgaccgcaagcctagtcgagattcatactgcatagtgtagggacatgttacttatctctgaatcaatactgcacactagctagataccgacaatgctccagatcgggcacatccgtataccctggccgcggatattgcaaatcagccaggaccatatttgacgccgtaaactccggccaacgccagcctgcaaagaactctaaggtggtgttgtaaccgcgcgctatcagatactccctcgcaacattaggatcacccgttcgcgcaaacgacccccacatgtcctgcaccgcattggtatagtagatatcctcgggaacccgaatcggctgatcgtaaatgtagtaagtcccaaatacctcgtacaagtcactagagtggcaccgataatatggtgtgtccggctttccgacaggaaacgtgcacaggtcatagaaatcatagtaggagagagcgtatccgcgctgatgataggccacgtgcatactagggaaagcgaccgtggcggcacccaccatagcgtaggcgccattcgggcactcttggttattttcggtggcgatcttgacactagcgttgtatacgctggagtatgaagttgacccgttgtgaaaggtctcgttgctaataagccacaggcctgaggggataatgtgatctgcctgttcttgatcgatccagccccctgggatgagcaggtcgagcgcggtctgaaagtcggtcatattgggtgcgagagtggttgtggtcagcgactgacattcctcgggcatcagggtggacatcatccgtacggagttaatgtaagagcttccttgggcgactagagccataggtgcatctggtagatatacaggatcgatcactggagtgaagaagatgtcggcgctggcgttcaggagcactgatgaaggcagtcgctgcaggcaggcaagccgggcagcgcctgtctcgttgcagtatgggctaaggtagggctcagctagctcggctattgcgctctgggtgctaaagcgaccgttgcctgctgactgctggatactgccctgaaataaaccagcagcttgaggagaagcaacaagctcgatgcagttggcgccaccagctgactgcccaaagatggtaacattgtttgggtttcccccgaacccgcggatatattgttgcacccaccgaagagcagcgatgttatcggacatccagtagtttccagggatggtgccatcatcgagtgataagtacccgaaaatattcaagcggtagttagaggtgacgatgaccacatccgagcgtgaagttagacttcctccatcgaaggttaggtccgagccggtgccttgagagaagccaccgccatggatccagaagaggacaggcttcagttgatcctcgggcacgtccgtatcgcccggaagaaagggagtatatacattcaaataaaggcaattctcatcattaccccaggggttcaaatcatagctatttccgtcaaagtaaccgaactgcagacaggcggggctgtattgagttgcattgacgtaacttacattggtcgcatcccaagcttcggcatactggaagcggcgtgtgccaattggcggctgcgcaaacggaataccagcaaatcgaaaagtcaaatgatcacggaggccttcgaaggtaatgttacctgccgtgacattaacccgagggaaggaggagtaatcggtgtcgacacgatcaaccagtggagccgagtttgtgcagacgaaaggccactctccatccgaagagacattatcggtggcagaggtaccagaaagagtgactggtgtactgcaagcagtccagagcagcgtatcgttagttagagtacctagatactgctggtactggaaggactggcggaaatggtgtacatcatcgcatcgcagcagttgctcctcatattcggcacagactgtttctgcctgacgacggccggcaggtgtgtgcactagcagagcacttggtcgctccccatgagcagtccagtttccgtcgttctgaaacaaaaggcttgtcggagcggatgaagcttttgccccggccggaagagccagcagcagcagtgacgccatggcagccatcctgagcggggaatgcctcattctgtagtgactgctgtgggttgagatgcatggaagctgttgctttcccgtcccagttgctgccttatatgttgtctgcgtccgcactgttgatctgtgaatcccaatgcgggaaagactccgcaggttggcggccgcagaggccctcattttgcgggcaaacatccaacaggatcatgcatgcgtttccgtcctgcagagtttccccggagtatccccgcaatacggaaatgggctgatgtaccagtcgggatgtcaacaatggggaatggactgtgtcgtcacagtgagaaacagggcaagtatataatgttcaacaaatggaggtggttctaacctctagatcatctgcaagcttcattattatatgaatcgtgaccatggcactacagttcctatatcttgttactttccttctcgccgttctcccacctaccttggctaggaataactgctccattgagacctttcaagccttcttggacgccaatggtaccgctgcacgcgtagtttacgcccgacactatgcggagaattcgacgtttgtgaaccccaacatcagctccgtcaccaatcccacgcagttgccagcggcctgtgccatccaggtcaatgcgaccacagatgtgaacacccactttagctttggcgtctttctgcctgacacatggaatgaaagattcttgtaagtgactctgacctattgagaggatatccagtactaacttaacccgaacagtcacgctgcgcaggaaggcgaagacatcaactgggttgatatggtatgtaacagcttcgtcctcaattacaagtagatcgtagattgatcgaactactaggctgtgggactacggtatggcttcgcctctgtagccactgacacgggccacacgggctccgacatggatggagactggtggaagaatccagagtctatcaacgactgggcctggcgtgccaaccatctcactagcgtgctgggcaagttcctcgtcgagaggttctatggtcaaaagcccaaatataactacttcgccggctgctccaccggtggccgccaggccatgaaagagacacagaagtttccgcgggactatgacggggtgattgctgcctgcccggcatggtggactacccaccaacagctatacaatctcaagcagacgacctatcaggcacctcagggatcagatcatacaatcccaatggagatgttcgcagtcatcggagcagaggcaatccgtcagtgcgatcctcaagacggactggtcgacaacatcatttccgatccactaggctgtcatttcgactacctgcctttgctctgtactgagacgaagaacaccagttgcttgacaggaccccagatagaaacactgcataagatctacaacgactgggtggaaacaaatcaaacttttgtgtacacgcatccgcattacggcagcgaagcaatgtggaacgagagcggcgtcatcggcaacggcagtgtcggcaacgaagactcgcagctgtggtatcctcaacatatccttggcctcgccaactttactgtgcaggacttcgattatagcgtggtgcagtacgccgatcagactgacccgggtaattcgtccgccaacagctatgacctggccgagttctaccgccacggagggaagctcattcactaccatggtcactccgacgccattgtacctcccggtatcggcctctattaccgcgaccacatggccgccacgcttgccccgcagggcattgatatcgatgacttctatcgcttcttcgcaatccctggcatggagtgagtgcacattagaccaacatgggattacgagctgacttctccagacactgctatcatacaccatccacaatgggcgcgccgtggtacatcgccgggccgacgcaggcgagcacgctgagctcgtctctttacagtgtcccaggctaccaagatgcaaagcacgacatttttctggccttaatcaactgggttgagaacggcactgcacccgactatattattgggtctcgcttcaatagtagcgttgagtatacctccaggaccattgacaaacaacggccgatatgcgcttatcccaaattggcccagtacgtggggtcaggagacattgatgatgcggccaattttgagtgcaaagccctttattagttggtgcctgtggatgattattgaagagtacatttggggatatagaagacgtattaatttatatatacgagccagagaggccaataatgattgcattatatcgcccagtcagtggccatgcaaggggtctctttcaccgcccttacacatgataagattgcctgaggtacaaacaagtagctgagcttctcaaagaaagtggggaagagatgtcaatattatcaagcttaccgaacacctcccgggttgatgtgtgagttcagtcaattgcaagcaaccataatatgctccatgactgagctcaagtaacataatggatgtatttatggactttgaaaacatatccaggcatgattgatcctggaatcatctcgtttatcctacttatcttctcggtcgtggatttctttacaagatatcttgtctgtataggcagtctggcaccgttcatccttagacccgcccatgttttcctatcaacattcaaatgcattccgaatgcctaaatgcgctactattaccccatattcactgattcctacattgctatggtgccatttagtcatatgcgcggctaacgaatcttcattgcaaaattgaattggacaaggtacttcgaacttcaaatgtgtatctcttttttgtgaatgcaagaaacttcaagggtagcgtactgtgaaaatgcgcgaataactctagggagtgaaaagcatcaacaatctacaatatgatgcttatggtttatgacgccaacatcatccgcctcaactcttccgcttcgccacttttattgaccatatcctgaaataggccttcatccttttccaccaactctccaggacttccaaattccgctgcaacgccatccttcatgaccaggatgcggtcaaagtcggccacggtactgagacggtgtgcaatcactagcagcgtagtgttcgtgaacgcctctcgaatcgaccgctggatcaggatgtcagtctccatatccaccgcggaagtagcctcatcgagaatcagaatcttgggtcgggacagaatagcgcgcgccagacagagcagctgtttctgtccctgtgacaggttcgatccacccgaagaaactggcgaggataaggactggaatatgttggtgtttccgttctgctcggaagcggcaatggtggaactagcaccagagtggtcatcctcgtcgttcttcaacagtggcgtgctgcttccggaggggatgaggtggacacgcgctaaagcttctcgcacttcctggtcgctgtattgatttaaagggtcgaggttggaccggatggtgccagagaaaaggacagggtcttggggaatgatggctaggcgggtacggaggtcgtgcagtcgaatgttggcaatgtcaactccgtcgatgacgacactgcccttacgggtgtccaagaaacggaaaagtgcaagcgataaagtggatttgcctgtcattgttagtataagaagaagaacagggaatgctgcaggcaacttaccagcacccgtccgaccgacgaccccaatcctttggtttggctccgcagtgaaagtcaggcccttcaggatcgatggtagcccttctgcgtaaccgacctctagctcatttacctctattctacccgtctcgggccagctagccctaacgctggtcccgtctgggttctcgatccgcaagtctcgatactcgaagatgcgctctgttgcattcatgaacagctcaactcttgtggaaatttgaatagtaaaggaagtcaaaaaggtgaagcttagcgagaaggagagggcgaacccagccaagctagcgtcgatgccaggggtgtttatcacgaaggcagccacggtgactgggaacaaagcggccacaagtcccacatgaagatggagccagctgcccatatagcaagcataccatgtacaagcagcgtacgtgtcgatgagattgtacattcgtcgagtaaattcttcggttttggaaaatgctcgaatagtggagagcccagttaaggatgcagcaaaatgtgatatgaccggcgacttgctgttggattcgatgcgcctgatgtttcgtgcagcagcaatgtagctccgtgctataaaggcgcaagatgccaatagtatgatcgcaaccaagaccataaaccgggaaatgaagatggctgcaaccaatataccgaccaattcccagagcgtagcggcaaagtaatagaacatctgcgggagctgggagtccaagagggtgaagtctcctgtaaaacggtttagaattcttcccgtgggaactgtgtcgaaccatcgaagtggcgcgtggaaaacactgtgaagcatatcgtggaatattctccgtgatgcgcggacggctccagaatataggttgaataaccgggtgaccgcgaccatcactgacacgacggagatggcgcaatacatccccaggtaaaaccacaagcttctgttctgaacgttgattgggagactactggaggtgttcatgcaaagtttgtgcgttgatgttgaatagcctgccagctgcatctgcaggctgttgtggtgtgggcatgccgtatattgagcgactccctgctcatcgccaaacgcatccgcccaaattcgtatccagtagtttcgagacaaaatcaatgcctgaaataatgcaaatagaaaagaaagtaggatccaaaatggccaccctccggttgctttgagataaccagaatagactgacatctcgacgcgaccggtcgctctcttttccgcctcaataagcttctttgggggagccttgggcgcaatagtggcagagtcagtcggcaccgtcagtccttcttcttcctcaatcaagatctccctattagcagattcttggagagaatcgagctccccttccgcctctagctgctccacggaacctgcgtgcttaagcgttccgtcagcggagagactgaccgcatacttcgctccagacaaacacagcgacacatggtgggtggcgagtatccgagttctgccctctgcaagcttgcccatgactgcgttttcatagacatgcttgcctacgtgagcgtcgagagcgctgaaaacgtcgtccatgatgatgattcctgcgcgtgaatagatggcacgtgccagactcaaccgccatttttgtccgccgctgagactgattccctgagcgcccacttctgtctcatcaccatcctcgaacaaggccaggtcagtagtcaatgcgcatgcttgtagtacctgctcatatctgaccggatcaaagggtaaaccaaagaggatattgttcttgatcgtggcattctcaatccagggagtttgggcaacaaaggcaatagccgttggcaaaatccagttggccgcatttgccttgttatcgaagtgctcaatgggagaggcatctcgcgggacatggacgtagccgcccaacacctctacctctcccaaaatagccgccagcagtaaagactttcctgatcctgtcggccccgagataacactgagcgcattgttggggaataccaagttgagattgcgcaatgcgaaacggtccgctgatgcatccttagcatcgcaggggaagctcacagaggcattatggaatgaaatgacctcacccggatgggtgttttcctcttgctctggtgtgcggagaaatccgtcgattctgtcggaactcaccttggcggtgatgactgataccaataagtaaggaatctgcccaacaatgccttcaagctgaatgaatagactgatcgctgtaaaggctacagaaggcagtaagcttccgtggatgtaagagtatgtcgtcagagacaatgctgttagaacgatgggggtaaactccgagccgatcgtcatgtagatattatcgagcctgctgctccacagaaccgacaactcctcttcacgaacacgttcgagcttctccgaccacacatcttcggcagcggagaatttgatttgtcggataccatgcagagcttctgtggtcattgtagttcgtttatcccggatttccatcagggccttctgctttctcccatacctctccgctaaagctcggttgatagggaaaagaaccgcaatacccagtagaccagcacacaagctttgccagccgatgagcagccacaaaaatgccactgtcaccagcattttacccacaatgtttacacactgggagctttcggacgcaaatatggcgatttggttacagtcgactgcaaacatattgatgacgtcttgttctgacttggagggaccatcctggccagcctatgggtgaagcaagattagtaagacataggcacaggggccgggggtctgatacctcttcagttccaatctcttcaaccttcgcagggtcggtactcaatttctttcgcaacaatttacgatacactaatgatgtcaaggtcgaccgcagagcaacgacgatatagcctttttcccaccacatgatacgcgagtccaccaaattggtgcccatagcagccagtgcaatcaacatgacatatctccaggcagatggatcacgtacgtccgaattctctcgtgactcgaggtattgaaggagttgtaaagttgcgaaagatgggccgacgtcgaaaaagtttgaaacgagaactgcgatccattgccgcagaagctgtacccgaaactgccaaaagatgcggatccacagtggctgggcgtctgtcaaggccatggcactaaattcgtccgaggcttctttggaacggacagcatgattcatagtcggaagagcttcagattctaatgcttctttggcgccttcggacatgatctcaggagcccatcggaatgtcaatcggttccagaggttgacggtcatctctcggtcgatttccttgctgtcagggctaaagacagccgggcgccgttccacgcaccatatagcaccaaccagggccagaagagtaggcacctgtaccccagtcaggatagctgtaatgctaggtcgactcccgccggggacattttcgcttgcgagaacggagagagcaatacccccaatcagaacaatggttgcctgcttccatatcacgctctcgaatctcgcaactgggtgtgtctgggtaattgagtctgtgaattgcaccaacagaaatagctatgaattgtcagcagtccattcccaatgtgacctctccggtggtgggagagtgtcgacgcacgcacccatgctggcggcagcagccagattcctagtgaggcaggtccctttctcccatggatgctaattgccgcaatgatcaagtttgcaaaagacagacctaatccacaaagaccgagcaaaaaaatagcaacgaaagggcgctggtttgacaactgagaggtggattcttttgtggcaattccatctttatcctcataccggatgtcgtccgggttcgcgtgtttccatctcgccttgatcaatctcttggccggcgggatggtccccaacgaaatcaagacaaagagaacaacagctgcctctccaggggcgatggaaggcaccatcgttcggacaggactgttgaaattggtgttttctctgtgtcgagaatggcaaaaagaagggccctgggatttaaaaagatgaacagaagatggcgagctaatttatcgtgcatggcgaacggacggcgctactgcagtcagcgaatacgattagtctgccagtgataagccgctcccccgcgcgatgcctgtccgggagcccgacggagcagacgtgactcaacgcgtccgaaggaagccgataagaaattgaagttggcctgcatgactcagaatggatgaagatgattggaacctgtcaaatgaatggacaggatctggactctgatggaaagtgaggcagacgcggagatcgaacgggaaacaatagaaaaatgccgggattctggccggccatgtgatggaacccccctgattggccagctcgcgtccgttgcgtgttctcctcgctgcctgaggcggtcagcatattcgcaatgggaaccttcaatggcgctaagcttcgagggggcaaacctccattatatccaaggacgagtttggcaaaactagccaagtagcacagttcatccgagcatcacacctcacacaacatccggtgtcacgtctcgctatcaaaccacggcataccgtcgtcagcaccacctctttccaactcagcgcacgtccccctgctgcgccttcatcaccttgtcaccatgagtcaccaggtcatttcttatcaatttaatatcgagcgttaatactcttcatatctcaggcacatggagtgtcacctcaccaccactgtattggacaaccgtgacttcctcatttctccggatggtttaacccgacgctcagaacacaagagttgttcagccttatcgcacatataccccgctaatgcccctatctttagctatagatttggttgggacaagctttgcctagcctcttggccgtcttctctgtccttcatgtcgataacgacgatccgtttatagccatcccgaccatggtcggagctgtgcttacgcatgcctcctagaggtcatagaggcactctccgtataagagacaagcatggtcacatctttaccacctcatagggagtctattcattgaacatgctcaagacctgtggacttgctgagtgttcatagagggtagcttcaatatcaagccattacttcggacgacttatccattacccacagactaatcaacatacagaaatttgctgtgagaagaccttttcgtcttgttctggtgtttaacaaaggctgtcaaacatacctccccaatgctatctagatctgtctagtctagtacccacccgtgaagccaaattagagcctgcatctgtgcccccacacaagtaaataacagaatggatgcgtgcgctatcgacacaatcagctactgtagtctcatttggacttttcaaacaacgctcgtgaatgtgctccttagaaggcggcacggaactttcgtcttgtaagatatctatcaatcttgtctgggtcgactggggtggaatgcaagtgctaggtccgaaaggaaagtcaactattcataactatactagtctcacgattgcttggtggaattagtatacactatcctgcctaagttaaaccatgtattgtcgtgggaccaatgcatcagtccagtattgtttgctcggtgggcgaccgtagctgcggttatgaattgcgcccacctggatactgtgatgatgaagaacttgcatctagttacaacttagttaacgggcagcaaggcatgcttattaagcctttccatgtcttacaaatctccccttttcatcatgaatcagaaccatgcaaagctgttctttatgaataattcacttaactcccacggggtccagcaaatgagatccactgccccggtcccaccctgaactctaatatcgcatcgacctgccgtagtgcccggcactggaactctttgctcgccagagcttgctttaaaagcagaaagtcgtacaattacaatatgagcacttaacagttaccgttggatatctgtgactgaccactatggacctggagacgaacaaacgcagcagtaaaacatcttcccgctctcaacaaggatgcacaaactgccgacggagcaggcttaaatgcgacgagaaaaagccaatctgcacccgatgctggcaaaaggatctacaatgccagacaatattccggctgaaatgggagtcaaattatcgtgatcgaggtatcgcctttggcaggtcgaggctgaataggaagtctcctgatcacccaactggtgctccgggacgggattcgactttccccaaagacactacatgggttgcgatcccgacggttcagtcttgggcattcgtgaataacgatacttccttgattcgacgactttatgccgaggagcaaggatacaccgaaccacatcttctcccggccgtcgatgctagaacggcccttggggagctggggcctcgtgagccagcatcgtctttcacaacatcgccacccgataccgctcaattaatggatataaaagaagcaatgttacagaacttacaatcacccctctcaccatttccatccctagatgatctgggaaatcaagtactgttcgactattacgtgaaccagatatgtcctcgaacagtacagagtcctctatccatgtcaccctttgcctcagtcattcttccctattgtgtatccgctccgcccacagttctgcaggcaatacaggcgctggccgcctgtcactggtcccagagcgacccaaggtatagcgaactttctctgcaactaaaggctcgagttctgaaccatctccgacatcgtatcaatacgcatccccaggatatagtcacagaagaccctgaaatattggtcattatgatgtttttatgtttatatgacattgttgatgactgcaatcagcagtggattatacatcttcagggggcaaaagatatcattcgacttcgccgacgacagcagattttattgaaaggtgcaacgcaaggtgtacagcaagacccagtatcgtctttcacggagcttttcttcgctttccaggacgtgatggggcggactgcctgtggaaaagcggagctttttggatcgacctattggcgtgaagaagatacgaccataaatccttggatgggttgcagccctgctcttgtctctgtcttattctcaatcatggatctgagtcggtctagacggcatgtcatcgccgatgaaggtcacgaagcttttaatgttagagcttccgccctgatcaacagattgaaggatatcaaacaggagatgcgaatcgatggagacagccaggtcattcagagaattgccgagctaaagagagtgacttcaattgtctatctaaactgcgcattgtatggcttgacaccatccgattccataaccaagacctacgtgcgcaaaatattgaaagatattgttgaactactcgcaatggagccatcttgtcaggtcgtctggcctctttttgttgctgccgtggaactagatcctcttgaccttgcgatcatgttagatccggatactgggaaaatgacggacggacgaaggcttgtcttggaactgcttatgaagatgagtaaaagcagtgtttctagtgtgactcgggcgcgtgtcgtcgtcgagcaggtgtggaagtcccgcgatttttgtttgtcaaagtcttcccgagaaaggtcaccagcgtctatcacggatttaaatgactgggaagagtatgttatgcctgttagtgatgctttgagcctggcataagcgcgcaggttagcaaaagttagacgaaataagctcaaacgtaaaaaaaaaaaaattctcttgtgatcttacattccaactcatgatcgaaagacatatggtgcggcacaggtatatccgaacggtccccagaataacgacctcatttcatgccctccttcaaacgcattcgctttaacctctctatttttacgttaaggtgatatcaaaaatcacaaaagcccctggagtaattctctcatatatgcgatatactgcaccggctgatgctatccacgttcggatccctacatgcggggtactctcacggctcgggaatggcatccgtagcgttgtaagcttatatgattaaagacactgcaaaccctaagtggaacaatcggaaagacattccgcatatcggaatggactacagggctcctaagtcccagaaaagtccaactagcgagttttgtatactggggttagttcacccgctgacccctattgacccccatccgatatgggagaatgactgctcgtacatcccactttctgcttctcttctccagaatatttgctattatatcaaagtaatatcagaatcactgcttctctatcgttccctaagaacaacctagttagcacttttacatcaacccctccctcccaccgaggataaacaagaatgctcgtcaacaaagtaccacccgaaaccctcaccgtccctccaacagcccactcccccaactcaactcgtcccgtcctcgtctacaggaatgccttgatcgacaagacaccccaaggagccgcagatgccatagaacagtctgaatggatatatggaggccactggataatagcagaaaatacactggcagccgtccctcattaccactccatcacccatgaggcatatacagtcctccatgggacgggtacataccgcctgggaaagtcatccctcgatcccggatttgatgccaatggtgaggaggttggtgtggtgttcactgctcgcgcgggagatgtgtttgtgtttcctgtacgttatgatctctcttctctctatatggaaagatataactataaagtaaaatgctggtgttcttaacggacttacgtctacgcaggctggtgttacacattgtgtcactagtacctcggataactatgagattatcgggtggtattcgctagtaagtcgttaatgctactgttgatagcagcatattattgtgttctcgctttagttggactgacggcgtgatagaacgacaaaaattcccgagctcagccttgggactacgaggaggcacttgactcaccggaggaaacaaataggaaacgtttaatctgtgaatcggtatctacgccggttcttgatcccgtttatgggaaagagggccatttacctatcgtctggaaacgagactgagtgtcttggctgtcgagccaggatgataagttggctacttagagatcacttaatatcaaagggccttcagataccatctacaacactgtaacacggcacctgctcagataatctgttcttatcattataccaacgaggacgtccattgaatttggtgcagctcaccgcatattttcatgcttttttaaagcaaacatgtccaagtcctttcgagctatgcggtctttgatggaaatatgcaaaatgacgtagggtcatgatagaatcagaccacagaaaatgtcatttgtgttccagaaattcctgtacattgagtcagccagcctaggttctgatgtcaccatagtctccgacttgttgttttcaggttcggcgctcaatgggatgttccacaataagaagctaaaatatcagaagccaaagcataccatcatgtcatcggacccggctcggatgataggctggcgattgcctgttttcttggtttccggtgaatcttgcattgttgcagagggttggtcaagaataacagtcaattggtaaatattaccgccgctgtaggacttgacctccaatgcgtctgctgtcttgcctcaaaccgtgttcattcatgggtagaaagaggggaagcatcaacatcacaaaagtccatgggcgccctggaaaatgctcagctaacgcgttcaagtttttatatgctggctgaatatctgagccatagcaaacacacctgtgctcgcattactacatcagggactcatcaataatgttgcatatcaggtcacatccaccaacataaactcgagcatcaacgtgttgaagtccttgatcgagagcgatcccaatctctacaaactgtcgacagagacgttcacacaaactcgccctggagatccaaccatccctagcgaccttgcgacctccatcgtctaactagacagtctttttcgaagtgcgcccgcaatatctacccaacgctgggccagcagtccctaaaccagattcatgagccatacattcgcacgccatccgggtacggttcttcctcaactcaaaggtcagcaatgccttccatgacgctctcaaggactggggcggacttctccacactacagaattagcagctgtcctaaaggacgagcctaatggctggttcagccccgatgctctttccaacatgcgcaatttcgagaaaaccttcatatgcgaccccagcaaaccccactgggagttcgattcataggaggggttcttaaacagaaaactccgcgaaggcgcccgaccgattgcggagccagataacccgggtaacgtgtgttgctggttttggggggatcttggaacgtgggtcgtgcgagacgtcggtgttacctggggactatggagagaaaggcctggagattggaatgtttcattttggagaaagtacgcattgtcttatttttgagccacaggtcaaggtggattggggcgatattaaagatatgaaggttggacagaagataacccggatatccctgggcagatctggtggggtatctgagtgagggtgcaatgtacccaaagctttctatgtacccatctctgtgcgtctagtttgtctttggaagcttggtcatttagagtaattaccgaatgctatgaaagcatcatgattgttcttctagccatcacaggtttagaatgccatgagtactacacgatcttcgtgccgacttgcgtgtgaatttgaagggcgtcagaatatataatatccccggtgcttactagtatcatggaaaatgatggctttacaattcataatttcacaaaaaagaaatcacacagagtggctctccaaaattagacctgtctcgttcttcgttgttcccactggtcccgtcagacagggcattgtttgtctttgtcgagcattacaccggtcagtaacatcttaagtgtctatagtcacctagcagatggctgcttcggacatttttgtagtacactcagtagtaggaacgccctcttaatctaatccaaattatttgtactgcaagaacagaacctgcctgctgaagcggatgtttcaccaagtcaacgttccagaagagccaagccttctggtatatgcttgtgcaagaaccgcaggctgacagcgctccaacttgagagacaagcattcaggatcaggctcccacatttccatgcagcccctggtcggccaacaattgtaatcagcgaaattagatccgaccctatcaaaaaccgcttcccggaaagtggcagatcgactaaccctatcccggtcaagctttgcgcactagcccgccaagctctgactaatcaggaaattcaacttcctgtctgggaatggctccggaaaatgttttgcttgctagtcccaataggggctggtgcgatggatccaaatgactcgaaagggcaaccatccccgggggagaagttactgacccgaaaaaccctcgacagccagttatcattagtgttgattccgagtcaactcgcccccagggaccccaagtttaattgcgaactcctgtaatcttgctgccatggagttgtgttgctttaattggatcgtccgactgcatgtcagcagatccccaactcggctgcaacaacattatcatcggatggctcggaccaaccgctcagctgtctcctgagcagagacggaaggaaaactcttcgtcctccgcgacacgagcaagaaccagttttcaagggtaaagaaagtcccaggtggatctatcgtggctaccaatagccaggctgaacgagagacaccgtctggtgtccctttttcagggacaaatggcagattgcccctatttttaaaagttgggtttgggcccttgcccctgaaagctgcctatagtgggattagcccccgccgatgcctcggagactaagtgccgactcgctccttgattggctgcggccatctttgcttctgtgctatcgatagcttgctcgctagaagccaaagaggcactttttttttttatctccagcgctataactccgtcaatgggctcctcctcctccttcctgcctgccacgagccatgaacctgaaacccttcctgtcattcctcccccagaacagccacgaacccgcccatccccatcccgcatccaaacccaccaccaccacctgagtcgggtcaccccagacggctcataccaccattactcctaccacgcgctcctcacaaatccgccgtcatgctctatcttcgccatgcctggctcctgggggcgctagccaacctggtggccgccgatgaaaccgattgcaaccccctcaacaccacatgccccgccgacgcggcgctgtctacagagcacacatggtggttcaacgagacgctagatgacaagctttgggacatgcagacgggggaaatagaatacacatcggagggagcagactttagcatcaagaccgaaaacgcctccaccttgttggtgtcgaacttttacatctttttcggcgtcatggaagcacatgtcaagatggccaagggtgcaggaatcatcagcagcgtgattttgcaatcagatgatctggacgagatcgattgggagtgggtgggatacaacaccagtcaggtgcaatcagacttcttcggaaagggaaacacaacgacgagtgatcgcggtggctaccatgccgtcgaaaacgcggataccgaattccacaactacacttcatactgggacaaggatcgtctggagtggtggattgatggcgaattgaggcgcacggtcaactactccgaacccctcaccgtctatggcaagaactatccccaaacgccgtgcagagtcaaggtcagcaattggcctgtgggtattccgtcccagtcggtaggaaatatcgaatggggtggtggtttggtcaactggaccaacctccccttcactatgacggtgcagaagatccgtgtccaggacttttcctcgggcaaggagtacgaatacattggccacaatggctcttacgacagtatcaaggttgttaggtaagttatctatcattgatgctgcatcagatgagtaaaggaatattcattctaactgcccttatctctagtggaaattccactgccgccaaagaaatctcgaaggcacccgccaagtcgctctcccagaaatgggacgacctgggcacagcagcccacattggcgtctactgcggtgctgccgcattcgctgccctctgtattgccggctttgtgctgtacttcctgcgccaacgccgccaaggtcgccttgagcgcgctcttggtgagggtcaggggggtgctgccgtggacccgaccgagatggaaacgtacaaaaagcaatggaggcagagcgactggacgacccgtcgtgggtaccaagcagtgggtcaatagcctcaacactgttatttgccggtggtgttgtgcggaatttttacgatgggtgaagcacacgtcgatttgttgttcttgtcactttttcccctttttctttatcaagccatacttggatactcaccgtccattgcacaacacttatacttgttacattattattttttgagatacatattgagcgatttaatgcgtggtcttattttggtacttatattatctatactggtgtatatagatggagcggattttcgatcataaagcaaagcaattaatgtacattactgggaaagcattaccctcagttcctcttctaacactttacccagacgcacagacagcgagatcccggctgaggacaatttgttagggtggctactctgcaaacatagccacacgatacatccaatgatctacactccactctcatgcaaggaggttaagtttgctttggttgccacgcaagaaactattacccggtttttgtgcgcaagactgttgacattgtactccgtaagtacggagtagactaagtctagcaggcttgtcactcccccctcacataacaagcacattgtcatatgatgatagaaccccgatgctttatcccgcatagacatgaaccccaaatgccaaatcactgaactggctagacccgtagtgagacaatccaacattctagaagtatgcacaaaacaacggcggtgaaaagttctagactcaagtagcataaccactcatctggtgaatagtagctaagataaatatatatatacatctcatgtagtagtaattgatctcagctcccgcgcattgtttagctatcgcaagacacacaaccccaccatgacactctccaccaaaatcatcaccgtcttcggtgcaaccggtgcttaacctccctcaccccctcatttcacacataactaaatatctatatattcggtcaggccgccaaggcagctccgtcgtccgctccctcgtgcaaaaccctacttttcacgtccgcgccataaccaggaacccatcgtcgagcaaagccaaagaactcgcttccctaggagcagagctagtcaaggccgatggattcaaccgacaggaactccagcatgcgttttcgggtagttggggggcgtttgtgaatacgaactcggaagatcctgtgcgtatcccctctctctctccttgtcatctaaccacctgggcagtagtattgatttgttctttcctaggaactattatccaaaggcctcaacgacgccgacctaggcagcaacatcatcgaatacgccgccttatctggcgtccagcatctagtgtatagttccggtcttgcgatcacggaaatgacgaacggggcggtgcaatgtcctggacttgattgttagtatcacgtacatccttacttattcgatagcccattctatatctcacttgactaacagagacaaaaacagtaaaaatccaagtcgagcgacaggcctacaccacaaagagcttcaaatccgtaacccccatcgtagccgcctggttcatggagaactggctcgagccagactatgccgacctgttcggcggatggcccacattccctgactccgagggatatctgacatacaagacgcccttttggggcgggaaagaagatttcccctggatcagcatgaaggatgactttggagatttggttcatggggtgtttgttaatccgcttcggtggaatagacgcctgattcaggggtcgagtgatattgtttcgtcggcggaggtggtgaatacgtttgtttctggtgagttgataccctgatgagtggatggggtaggtgctaacggtgatggtgatagtcactggcaaaaaggcccgctatgaggttctggcggacccgaatgatatgaatacgaaaggggagtattggcgcgagcaggagcgggatgtgtttgtttattcgcagtttcgggatggggagtattttgggaacgggcctacggagatccagacggctgcggcgttgaagaaggcggcgtttaaggcgaaggggggcaaggggagggagacgcttattactgtgagggagtttatggagagggagtttgcgaaggtgtaaaagagggatcggggtatctatgttagagactggttacaaataaatgtttgctcggagactgtgcagtgtggtgtctcattccagcgcagaacgatacgaaataattatatggtcgaacattcataggtatcttgtctgatattcgtgtttattatcttcgtgtcatgtttcgattacttagtacttgtcgatttgtatagccaatggtctttctacagctggctgtcttgtatcccttgcacttctggcgtatgctttatgcgcgggttggagtagcggtcaatctactcgtgccgtgactcatccagaccaccatctggaaagagatagggccagacaaaaatgcccaaagcatggtacctgccaaggttcctggttggttgtggcagtgagcaaggccttctaaccgagcattcattcacgtagttcccagcacgatgagtgtgggctgtaagataatccactgtagctccgtatatatgtaaaaggctataaatataaagacacgcgataggtaacattttaaataaatatacaactcggtaccacctctaaggcttactgtacatattctgttctctctaaaaactattacaaggcccatctaaccagtcgaagtggacgaagtggacgaagtggacgaagtggacgaagcagacaaagcagacaaagcagacgaagcagacgaagcagacgaagcagacgaagcagacgaagcagacgaagcagacgaagcagacgaatttcagctagggctacaactcaccaacctagcagcctaacaagaggccaccgaagggaagttcttgcaagcggtggacttcttccccccggtaactttcacatcgtcccaggtccagtccgagcagctaccagacccgcaaagaagatagatctcagtagccccactatccacgctaccagtcacgctctccagcttaacatcctgaatagtgacaccgttcgtcggcttacccgtaggcttgccgtcttcgtaatcctgctgaatgaccacgccgtaatcggagatgccagacatgacgatgttggagtacgtaatctcggacacggagccagtggcgccagagatggtcttaattcggacggcgttttcggaattgctcacggtggagtgttcgatggtgacgttcttgacgacgttgttggagcggtcgccgacagagccgatggagagaccgtggccgccaatgcaggtgccgccggtgaaccagatgttctatagaatatcaatataattacgaatcaagcatatatgcagagctgcttacctcgccagagttaaccgcaagacagtcatcctggttatggacccaaggcttaatgatattcaccccgaccgagttgccaacatcgaacgcatcagtgttgtgtccaccctgggtgtcgccatccgcattattgatggtaacatcggtaaacgtaatgtcattcgcctggacactaaacgccataaggggggtgtttttgatgtttaatccagtaatagacgaggagtcaaggccatgggcgtaaaagaacttgggcttcttctttccgctggttcccttgccatcccaccagcgcgcaccatcgcaattgatgaggtggccggaggcaccagtgacggtgatatgttcgccactcatggagatcaaggggcctgcccattcttcgtactggaaggtcgtggtgccctcgaagatgaccttggtaccgctggtgagaccggtcaggtcgagggtggttccagctggaacttcgatgttgttaagggtgatagtagagcatttcgccttgcccgctttagcagcggcagcggtggtgaacgtgcagctgtctcgagcttcgataggagaggcagaagcgaaggtggcgccggcgaccaggccgtaggcgagaagagaagcaaacgagtgcatgattaattgttaacaatagaaaagaatgacagaaggagtgttgttggtaagattttgaatgagtgtggaatgatgagcaagtagacatcagtgtgagcaggtacgaggttcttatactcacgactattgcgaatcttttccggtcgaaaagttcataactgccgacagcccctggaggaaatgtaggaccctggatcctcgtttcatattgaggtgttgtctcaaatattgcgttttcccgtgaacctcagttcgacatgagtggccgattaatttataccagccgtgcgtggctgatcagccgacgggttccgcgggtgatggaacggatgcgcatgtcggtggaaagaaggcaaagctccgctcccgagggtaaacctattgtcaaaaagggcaagatagagaagcgtttgtatgtaccgctgaattggcacgtaaacaagcaacactataattggccttcacaagcagccgtaagtcctggaggaagcggatgccatcgttgatcccgagattccaggccggtactgcagtgtacgagtacgagaagacagctatactaatcctagtaaggctgcagcctgaaatgcagggtccgcggcaattatggtgctttgctagttccaccaatgaacggtccataaactccctgtgtgccagattccggagcgtaatcggctagtctgtagccaatgttaatatcagagattcgagatgaaactagcgcagcgtccatccgttccttcgacagctaaatcaggaatagtgcgcaaagctcgctaatcagggtcgaaagcttgccggcaacaagcaacctggagtggggccagtcaagaagaggaaaagatgacgaaaaaggaggaagccactggctaacggtgagcgaatccggtggactatactggtcacagcagtggataggggcggttagttgttgaaaggtcattcatcaagttacgttttttcgatacagattgagcaaatctttccacctgcaacaacctcagcccggtattctcgatatccgagtgatgctatcgagcgcgaatatcaacattcctcctattggattcattcctcggggcaggaggacaaagtagtgctggcgcaaaacggtttatgtctgagtctggtgcatcggaagccaccagtgcgcacactattccatcatggcaggtgaaccatattgtcccgttcattaccctcttctagccggattcgctccattacccctattttcaaggttgtagaagccagctatattgagagggagtcatgctctgacctggagacaacgcgttcgtcaagcagattaaccagcgtgttatgttctccaccacgggaagtgcttctagaaacgaaactagtagggtcttattatttaggtcttcaatgagcatatattcgggcgttatgaagatttttaaggagcttaccaacagtgaatcgtcaaatcaattacttatatgggcctataatctttggaaaatggcacaagttaattgctgcccttgcagtgcgagtagctctgggcatcttccatcatctcgttaggtgtttcttgggtagtaaaatagaatcaccaaatacaaatcgaacgatactgtggagagcagagagcgcgctggatgagatgtaattctcggggtaaaggagggaaagcgtgagaagtgaggatcgagagtcaaggtcacgttctgttttcaaataggaagtgcactacttacaccttattattgcttgcttgatcatttctattgccagcactccaacgaaactggtcggcattaaggcctggatgtagctacgagtatacctggactcggctcagttggtcctgaaacaactttgtggatggtagatttatcccatggcgcaactgatttcatatagtacttgaaccactgtagttactataatcaaatgcaaatacatcatgatgcctatgcacatgcccgataatatatgaaagaatacagctcaaccacccttgcggatcgtccatcaggcaagtttcagggtcacagccactcattggtaatgttcaagcaaaaaataccctccagcaaacaggacacgcattgtgatactcgagaaaccaggtttcaaggcactgtctatgaaagacatgcttacagggcagtgcatgtatcacatcatctttgttcacagtttcgaggcatattgcactataatgacaagcatgatatctgttagtgtccgcttgaataaagtcacgttcaatcacaaccatagtcaaaaagccaacgtgaagaatggaccaaccagatgctattctcccaatccctacttagtaacgggctccgttcatgacaaacagctgagatataccacgaatcataacgcttgaggggtgcgacgcgattaagagacttcaggcgctggagggagttccatgcggctgtatggtccggagttgtggcaggcgtcgaggtgaagtcgagggtgccatatgcgatgcagtaggatttgaggagaagactatagcaccatgttatccaattttagtacagcttctatcagataggaggagcgagatagaagctggagttataccagattgcagtgattatgtaaacactcagacagagaatcaggaggatttggagttgaagggctttatcggggactggtggttctcctggttctgggtatggagtctcttgcgagcctggctccgtcattgttcttcctcgctccccttctggggatctctaccctgtatagtaggaattgctgagggcgtcttcaaggggatgggagcgagggatatatcgttccatagggaggtccatcaatataacaggcccgggggacatggtcttgcggccgaaagaatgccggatttcgagaaatcgcacgagatttgcgtgagaaaagaggaaggaggaaatgcggggggtgtctggggaagagcattgggccaaccatgaaataaagccagccgggtaccttctgccttgtgcttccaggggagcatcacaaataaacttttggtttctgatcccactaatcatggcattaatctggggggtggtcatagtgacgcgtccatttccagctgtcaatgcagtaggagtctgttgtggagcattcacagcgtgcaagaatagtcagaccacatggtaaaatcatcgtcccaggcatctggaggaatatctccgatatcagcaactaaacgcaccgcgctaattagactttccatagtcacgtctaggcctcaccagatagttctaaaagcatgacaggcccgtgaatggtcttccaccaaatgaacccctatatttcaaagcgacgaacgactgcttcattcctttctcaatactgcacctccagctcaaccaccacagatcccataatgcctaccaaaatccctgagcacctctatcacgtcctcttaaccatcactcgcctcaacaagaaccccaacaacctcgtcgaaatcctccgtatccctggaacttacaccagcctactcgccgccaaagccgcggcgcacagctgtctctacgacgccggctacgagcgtgacttctttccaacctatgaaaccagtgcccacattttcgaacaagaaaacctccccgatcgcacaggactcgccatctacgccgttgcgccagacggcactaccttccgcgtccgcatcgataccaccacgaacaagctccagctgaccaccgatctcgacgatggccgcatctccatcccgctgttctacgtcgtgcaggcgaatgtggaatatgatgctattgaaggggaaagtaccgtgcgggaggtcatagtgcagggcacatttacagattacatgcaggcccgaaaatacgcgaaggaggtcttgttgtcggagaaagatggcattctgaagggcagttatgcggcgtatgtggaggccggggagggggaacgggattgcggatttggcgagaatgtggtggtgcatgcggcgtcagattatggagtgaactatttggtcagtgtaatcagaaaccaggaattggggagtgtgagtttggcggaggcggcgatgaggattggctgatttgacgttgtgttcggcgctgtacctccatttctcctcgtacatattccacctagtcctatggctcatgataatctctttttcacttttgtcgcaccagaatcttctggatacgacaagtcacaagcccgccatcatgccatccggcatcgatttccaggcgtggttcctcaaccatggaacggcaccccccaagaccaccttgacttccaaccccacgcatccccggatttccactaactttgggacccgatcttcaagacccatctcatgatgcatgttcagaaagcaaaggaaggaacatgcaccctctagtagtttctatccgaagagactcctcgcgagccacccggggtacaaatgacagcatgtttctcgaccacaccatctcgtccttcacgttccaccgcatacaataatgtgcagataaaagtatcactcagaaaatacattcacacccaccacagcaaagacccccaacaatgctcaaacaaaccacccacatcctcagaaaaaccccaaccatcaccacatatccaatccaccatctacgaaacctacaaacaacaacccctcgaacaatgtccctcctaccacaccacccccgacccgtcccctcccttctgcgcgccttcaccgatttagacaactacctcactagtacatccaccgctgcagactccctgttccctaattccccgcgctttgacctccgcgaaaccaaagacgcatacatcctagacggcgacctgcccggcgtcaagaaagaagacgtcactattgaattcagtgatcccagcacgatgaatgtcaggggtcgcagtgtgcgcagcaccgagggggaggatgggaactggtggttctcggaacgtacgatgggggagtttcgtcgctcgtttagtttcccggccaaggtggatcgggagcatgtggatgcgaagttgacggatggggtgttgtcgattcaggtgccgaaggtggaggaggagccagaggaggagaggaagattgttgagatcaagtagtagctacattctttgagtgggggggtaggtaatattggggtagttgcgttggtacatttgttgtgtataatacaggtttgattgattgtgcttcttccaagttgcgagggagggatgatattgtttgtatgtattaaaaaaagcaaaaagcaaaaagagatggtcccagaggggctcgaaccctcgactttgacgttattagcgtcacgctctaaccaactgagctatgggacccagttgatgtatagttggcggtaccctggcaatatattctaacatagaatcaaagttcacaattccttggttctcccgatcatcgctcacggctcgagtctcagccataacaaagcagtcggtctgtcgcaacagtataccatcccctcgtatttctgcgaccttgcgcttcatggtctttataataccgatgagctcgtagagatgctacgtactactattcctgatattcatcctgatgagctgttacggtaataccagtagtacttggctgagatatatataactactaagtactagtcaatgaaacatttgtgagaaaaccagcctggaacccacaaaatgcgtagggatctgtctagtacaccgtcacactgccagccctacagtagggataccgctgtcaatgcctcacctttggcagatgactaccatatcaggactggtgccttattgctccgtcactgataacgagcctccggggcacatgaactgctgcaaagcaatgaccgcgacgcaatcctctccgccgcgtgcaatcccatgatcaactactataaatgagacttccgccatttatatttacctcttcgctctatcttctttccccgtttaccccacttcctttgatccaggaacgcactcttggcatcacacttgccagtacaaccctcgcaaattgacagcggctcaactttggtcacttgacccaaagtattataacccctcatatgccacataggacatttcagccagatataccaattatgtcatgacgaaaccgtggccaatcgtgtggagttgactttctccgcgatggctatcacacatgccgtccgttgacgatctcgtatcgccctttgcacacaacggaggattccttatcccgttaggcaaaatcgttatcagagcaccaatcatggccctgagctatatcttgaaactgatacgggaacgaccatataaagctcgagataaagacagcccccagtattttatagttacggcaccccccatcctggtctcttgtgccagaagacacaggcatctgaaagacctggcgattggcggcatgcacgctagtcggaacctggcgatatccaacaaaatagccgaggtaggggaacgacggttcagtcagtcatctgtacagacgctcagtggtcgaaaagtagctaacttgttcgaacaggctattgtatccgtgccgttcgcagatctcaatgcagattgcgttggccaagccagacatgggctgcaattgcctaagcttcgctgtcacggaattggaatgattgacaaagatgctgcgccgtaaccgattgagatatgagttgcgttctgcttacatcgcttaattagacatgatcgggatactcctagctgcttcaccctcagcacctttcttgcgatatcggacaaccgcaactgcagaaacattgttatctcaattatggggcatcgaccagccctctttatctatttatctcccacaatggccattaccaaattcaatgaggcttctggggttgggcttggcggcccagggactcccgactggctgttgacccgaggtccaacaacccccatcggccggatccgatggaaaggcagccggcaggtggagaaaagtccaacgacgatccccaaattctccagcggggaaaaggacaagacgcctgccagcttggcgatcgatgcctgtctctcgcgatcctttgactttggcacagcttcggttacaggaatcctcttctagtccggaatgccccaagtccacgcgacagacgggcgccgccgatggccgacccatctgcaaattgctgggacgctttttataaaatgtccgcaccggagaccagggttcaacggcgtgagccaagtccttttgatcactacatgcggggacatcctggctgatgtcgcgatcgttgcatagaatcttctactgcatgtcttagccatgcaaccatacttcggcctacgcggcgctcttttgaatcgcgccatcatctggctggtcgtctgcccggcctttgtgtgctatggatacaaccagggagtgacgggaggtctcctcacgctggagtcgtttgcggagacgtttccccagatgaacactttgaccaccactggggcccagcagcactacaactccaccatccagggtaaggcgcccgctccctcacaactgccctccctctcccggtctaaccatccacaggtacggtggtcgcactgtacaccgtcggcggcatattcggatccctgtcatgcatctacctcggtgatctcctcggccggcgaaaggtgatctttctcacttcagctatctcgataattggggccctgctgatggccacttccttcggactggctcaattcatcgtggcacgtgttgtgctggggctgggaacgggcggctatgttgcaactgtgcccgtgtggcaggccgagatctcgcaggcgggcaagcgtggtgcccatgtagtgacggacggtatcttcattggggcgggaatcacaatctcgctgtggactgacttcgggttctacttcgttacgggtaactccgtgtcgtggcggttcccgctagccttccagatcgtcctgtcactcatggtgatggccttcatcatatttttcccagagtcgccccggtggctgataaagcgaaaccggaccgaggaggcccgcgagatcctggctgcgctggccgacctcgatccgaacgacgaaagcatcacactggctgtgcgcgacatcgagcggtcgctagccctctcgggatcggggtcgtggaaggacatgctgagcatgggcgaacagcgactcttccatcggacggtgttggctgcagcaggccagatgttccagcaaatgtgcggaatcaatctcatcaccttttacgccacaaccattttccaacagtacttgggcctggatgccataccatcacgcattctggctgccgccatgtgcctcacccagccactgggtggattcctcgctttcttcacgattgaccggctcggtcggcgagtcctgatgctgtggagtgctgtgggcatgtccgcctcgatggccatcctggcgggaacaacgtctcgatccaacgataccgcggcgctggtcgtagcggtggtgttcctgttcgtgttcgaattcatcttcaccgtcggatactcgggtctgaccttcctgtacgcgacggaggtcgcaccgctgcaacttcgagcggccatcagtgccgtatcaacagcggccgtgtggaccttcaatttcctcctcgctgaagtgaccccggtgggctttgatacgatcggataccaatattacatcatcttcgcggtgttgaacgcagtgattgtgccgatcgtgtacttcttcttcccggagacgaatggtcggtcgctggaggagatcgacgaaatcttcctgcagtcgaagagcgtgtttgaccctccgcgactggcgaggacattgccgcggatgcatctggcagaggtggtggatgatccggaggaggtggccgatgcgaaggtgggcaagagttgagggttatgattgatgattatgatatgcttgaattgcggattacatagctttttgatgttagtcgaatcggacatgtttcgtatgcaccccttgatttctctccagccaatgttcactgttaggataggtaggtcacctgaccggatgtggtgttgctcggtttgtttcggtcttacgggtttagatttcaacctcgccaacgtccactccactcttacatgtcatcatagttcattaccatacttctcactgatccatctatcttggctgtccaactggcagcgtgagatgggaatgaacataatctggcatgcactggagagaacaaaagacgcagccactgaataaggctcctggctgtccggagtccgtctcaccaacgatgataaggtttggacggatgcagaatcccctcaccaaatcagtccgagcccaggcccggactgaatcttcagggttgactggcgttccgtggggatccgcaaagccgagagtggctgcgtgttcttgtttaccccactgcccctccgaatctgagccaaagatccacactgacgcaagttgtatccatagacttgggagagctacactgcgcgcccggccatgccaggttgttgagctatacgacaagatactcaggatactagcaagtgaagaattgaagactattgttgaacattcatattcattacatacatgtcataaacattattttctatccgaccgcggatgataatttaccgcacggtgtatcctccgtcaatgaccaaatcggcacccgtcgtgtatgtgctggcatcactggcgagatagacatatgcacccttcagctccttggcatcaccgttgcgtcccatggggatcatcgacatccacagatcctgagtcttcttatccacaaagtccgacagccccgtgtcgatgtaacccggggagatgctgttcacgcgggcaaagtccctccactcgttggccaatgaccgggccatatggatgcagcctgccttggcaacgttgtacgacgtctgctcctgcgggaagttggcaatgtgacccgacatgctggaggtgatgatgaagctgcccgttccgcgctgcttgaagtgcgggcccaccgccttggcgcagtggaaggtacccgtcaggtctgtctggatgacctcttcccagtcctcaacggaaccatccaggataccactgctggctgtcttgccagcgttggcaatgaaggcgtcaatctggccaaactcggccagcacgtcgtccacgagcttcttgacgctgttccagtcgcccacgttgcactggtaggccttggccttgacgccgtaggtgttgcgaagttcttcggcgttcttctcaccaccctgaggacgagaggagtaggtgagggcgatgttggcgcccatttcggcgcagccacgcgcggcttcaatgcccatgccgcgagggccggaagcgccggtgataacgacgaccttgcccttcaggctgaagaggtcgtggacgctggaggcggagggaatggagataggcatgttgattgaggtagagatgagtttggtaaatgcagtagatgattgttgttgttgttgatgtttgttgagatacgacgacaggcacaactatatatgctcgtccgagagtgatgaagtcatcgctgtgatgatgtcatgaccgaaaccggttgcttacattccaagccctaacagaatttggcaaccagccctcctccacctttcatccacttcaatgcagatgtggatagacatggattggccactcaaagcgtcggattcccctggctgttccgagtttcattaattccgctcggcccgggtcggtcatgacgacatgtcgccgccggccgatgcaggttctgcagggtctctgcaccctattttactcaacatcatctctgcatctgtcaagcagataccttgcaaggaatctacacagagaaagtcatgtccacccctgccgaggagccacgcccgtcgctgcgccgcgctagcacagtgcacaccaatgagttcgatgattcgtttctgggacggttagtctgccaatcattgccaatcaatccctgtcagacagccactaagtgacgttgcagggtgcggtcgttctttcgccgggacccccatgtcggggtagtcagccacaatgatctgcgtgacagggaggaccttgagatccatacctggaacggcaaggatgacccggacaatccgtacgtcaagcatgcagttgctagtatactagttttaacatattcaggttcaattggagcacctcttataaatggcttctcacggtcaccgtttgtttcatgtatgtcttagccttgttctcgaagatggcagtgctaataggtatagttccatcctcactggtatcccggccggttcctacggctccggcaacaactggatggaagaacgattccacgttcaaaacaccccatttcctaacctttactgggccacaacatcttggaacatgggtgcggcgttctggcctctcatattcgtgcctctgaccgagtcctccggtcgcatgcccggctactttgtcgcctacattattctcatcatctcgctattcccctccgccttcgcccaaaactacgctactctcgtagtgacgcgtttcttcggtggtggtgcgtcctccgtatcgatcaacatcgtcggcggtagcatcagtgatgtctggtatggtgacaaagcgaggagtctccctatgtcgctcttcggttttaccagtgtggttggaattgccctgggcccattcatcggatccgccatcgtagccatccacaaaaccgccccgtggcgctggatcttctacatccaaattatctatctaacagggctcctacccatcttctggttcatcctgtacgaaacccgcgcggacgtgatcctcacccgtcgggccaagaagctccgcaaagaaaagcagcgccccatctacgccgaagccgagctagacaacaccagcgtctggcgtctgatgcagatctccttcgaacggcccacacgaatgctcctcaccgagcccgtcgttgccttcttcaccctctggatctctttcgcctggggtatcctgtatctcttcttcagcagtgtcgttcagaccttctccaccaactacggcatgaatactttgcaaactgggtgcattcaattggccatctccgtgggtgctctaatcggtactctcgtcaatcctcttcaggatatgctgtatttgcggtcggcgaaacgcaacaaagagaagcccgggaaacccatcccggaggcccgtctgtatactagtatcattggcagcttgctgttcgcaggcgggctgttctggtatggttgggccagttttccttctgtgccttggattgtcccgaccctcggcatcggggctaccggtattggcatctacagtatctacatggctgttgtgaattacttgacggatgcgtatgagaagtatgccgcatcggcattgtccgcagcatctctgggacgtaactcctttggcgcgttcctaccgctggcaagttaccaactattccagaacctgggatatggctgggccgggtcattgctggggttcatcgggctggcactgtcagttgtgcctgtagtgctagtatggaaggggccagagatccgccgacggagtccattcatgcgagaatcaacctggggagcagacgaggaagaggttttagagaaagaaggtgacggagaagcgacggtgtatcgcgacacgcacacggggtatccgcaacacgaccgggaggaggacaaccgcgtgtgatgaagagaatatctccacatatcttaaaagtttgcatcattaaactatatacctgtaattatataaaacaagaatacaaacgaccgattacttgctataattctgatgccacgtataatccctctccttctccaataaccccctaatcgcctccctcggcgtcaccggctccctccccaacacctcccccatcaacccatccgtaaagccggcctccccattctcaatactctcaaaccaccccaccaactgccggaagaatccctccgctttgcccccgatatcattctccccgttgacccgtacatatgtctccggatcgacgatctcaatcttgacctcccgatgagtcgtctcattgataacctcaactatatcctgcatagaaacaggctccgacgcagtcaacaacacaatctccttatcgtgaccgcccttcaacatcaacttagccgttgcttccgccagttcagaccggagcgtgaatgcgatcttccctgacgcggagggcagataaagagtcgttgactggggataccagttcaagaagagagggaatgcttcagtgtagattccttcgcgaatggaggtgtaattaattccagacctgaaatataatcagtaaatggtgataaaaaacaaggaggtggaaaggaaagggagggaggtgtactctctcaacatatcctccgtcatataatgcgcctgctgcaccgcggccttggaattcgatcccaggcctccgaaggcgagagaggtgtaccatacctatcataccattagcatctttttcatatggaaatattatacggagtgaaatgtaagcgtacatgcttaacaccattcctcttcgccgcctcaaccacattcaaatgctgtcgtctgcgcttctcgacgtcgaatgtattcgtgctcacgaagaaaagattctctacgtctttgaaagcaacgtctagcgtctccgggtcgtcgtagttgactgtgcggaaggggatgccttttgaagtgaagcgatgggagttggatgggttggaggaggcggcggcgtaggtgatgctgtttgttgtggatgattcttgggttgggggaaagtgcgtggtgaagtagtccaggatgagggagccgaggccgcccgtgctgccggttaggaggtaatttaggggcatgatggtgttttatttctggtgtgttgtgggtgaggttgagtgttgtgtagtggttggaattgagttgagggaatactaagggtactatttatgtgatggagtgttggttgaagctatacatgatgggattataactagggtaactagctattgctgataaatcagacatttgtcagatggtgtcatgacagtgagaattattggtggatgggaggtgtttctaggtgttactagtgcttattttctgtgttgagttatagtaacccttcacgtaaatggatctgctggtttgtgcttggcgtggtgttgcttaccaagcagtgtatgcaggtcatcatttttgaggggttcaagctgtgacgggttcaggaactagtgaggcgggttcagagaaatcctgatactgaatgactttaatcacgtgaaaagagtggaaagatagatttctctgaatccgaaccagctttcataaaccagaatcagctattatatctactatttaaggtcttcagagggttttaggattgctttctaagaaatcttaggaatcacgtgcaaacccgttctagtatcaaaaagagcacccagttgcgacgaggtcagaatttagtacgacagtgtcagaacagagctggaaaaacagttcagtcagagtcagagaaatcctgatactgaataatctcatacacgtgatttaatattctgtcttatgttcagctctgcacgtgattataattcttaactaagaatctaataaaacctctaaaactctctgatacctttaaatactcttaatagtaatctctaaaaaactcttagacattctaaaaataaagatataatagctgatttagttcagaaaagctggtacagaatcagaaaaactcagtctgatcccgagtatatttgcacgtgatgaagctcatccggtgttagaatttctctgaacctgatgcactaatttctgaacccgttgcaactgggggcccctatcaaaaaaagtataagatgatgtgtataagctcattgagtatccggattcttctgaatcagtccgaactgtttttccagctccgatctgacatgccgcactagtttttgaacctgttgcaattgtatgcccgctttggactagcgcggtcttacgtctagcatcttccaacaattgtactttctcgtgctgtgcttagcttgcttagctctgctcctgatcatggttgtcgactatctagcagacttatatcatcaagcttgcatatatactagcataacatgcaattgagatattaccacccctgaatgaaaggtatctctccttggcaatctcttcatagactaatgcgcactcagccaacacagcagtcaaaccaaaccaacaacataatgtggaaatgagaagcacataataacagagcatattacaccccaatctaaccctgaatgcgatcctcaatacataagcctccaaaacacacagtaaacagcaagtaagctccatggggccaaagcttcaggccttccatccgatctgcaagggcccgaatatcccatcccctcaggcgtccaattggggccaaaactccacttcatgcagaatagcataccgaatacagaatggaacaatacatacacccatagaaggggccaagaattcaactgaagcgtgaaatgagccaccacaatgggttcacgatgattgcgttggagaatagatgggtgtttttgcccttgcactgccctgaagtgtaggaaaaagaaaagtatctgaatggggcggaatgctgaagaaggaggtataaaatccgtcttgttcgctctgaatctcgacaatcatccagctcagcttctcatctctcaatcatctacatatcactacaagacctctatcttcatctcaatctctaaagagacctcaaaccaaacctcaagcaaaatgcaactccaccagttcctccctctcgccgccatgggtgtcctggccctcaccaccacggctgaagccactcctctctcatcccgcagcgaaagcatcaagatcactacctggtccggcaacaactgcgagggttcttctgccaaccctgccatctctgggtctggagactcctgctttatgagtctccctggagcgtctttcaacgtcgataccggcgacaacaagtgcaagattactacctggtctggcaacaactgcgaaggaagttcggcgaactttgcgggcaatgtgcagggatgtattggcattccgtttgggtctgttagcatcgattgttaggtgatagcggactgtgttgactagttctctgttgtgtcaacttgaatgagtgtctggaggctgaagttgtgtttgatggactgtttgttgtatgagtgtatttgttcaattctaggttatagtttgtatcaattgcagtaatctattcggtattagtggcatttgaagtcaagagtatctatcggcttacctattaaataactgggtatcttgggatattttaggaatatctagagcattagagattgtgaggaatttttctctttctttctcaaattggtatttgtgctattttaaatcacgtctagtgctgatttggtatcagagctagtctcaaaaatatatataaatttaatcagtatcaggatttttttctaagtgtctgaatcatttttcaagctccggtgtgacacttctgcaagtcgcgtgtaggggccctggagacttgggatcccacgaaccttttgacgttgaaggtatacatgtaggtgctgttaccgtcacatgcaatactccattcataactagtagtaagcgtccaagacaagcatatattgcatcacgaacactcaagatacagccctggacgtggagctggcgactctattccgtcccgcaaaccgatcctatgagtgtttacggagtacggaggagcattaagaggcgcccgttggattgctaatgagaacactgctaacctgactaagtcaccctctactaactatatggtagttaataggttagcagcccttcctcaggcagcagctaaaccatggtcctgggggttcgtgactagagaatgaggttgtctgcatccacccattgtagcgagggctgcgtgttgaacaactcccacatgtctgcgctgttccaccacgggcccatctcgggccgcacatccatggaaatcggctgctccagcgaagaaaccattgttgcatcctcttgaactacaggggggttcaccaggggactacacaagttgaggaaggtggtgaagaggtggtatagccgggctatggccgggttgtagtcgatgaactgctgcagtccctgtgtggtgtcgcgcagcagctggtagtcttccatgttggatgtgcccaccacgttgcagaagataacgtaaaagggggtcatagggtaaaacaagatggtcctgtaggtgaatgtttagtccctgtgagaaaataggatgggccgtgcttaccaggagagaaaaatcggatagctgccgttgaatacgtcgcttgcgttgatggtcttctgcagttggcgcagcgcttccagagcctgtcgcgcagattgcaaacacttatccttcttcccaggcttgtcctgctcccactcggagcggtactgcaggagtgtggtcataatcgcgtggtaccggaactcggtgacatcccattccagctccaattcctgctgactgccgtttagacggcgctacagggtcaatacctcacatcttcactcaggtagttgtgccgcttacctcgtcaagcacccgcttcagcgcaaccaactgctgaattgccgcgtccagcctggccgccctctcctcaccatcatcgtctgctattgattgggcaaaaaagacctcaagtgcagcctcctggacttctgcaaactcagacattgttttggcaatcatcgccagccccgcctggccattggtagctcttagcgacgcggggctgaatctcaaccgtggaagcgacggtggccgcagaagatgcatgctaagcgacttatcgaggtagtggcaggaaaacaaacagcggcgggcgtcttcgtcctcctggctctgaatcggcgtgtcgctgctgacggtgtggtagttcagggcaacgagcagccgcgcggcgaaggatgtcatcgtccacgctttcgtgatatttccttgcatctgatggaggagtgcctttgctttggtcagatgttgtccgaattctttctgagaaaaaaaaataaaataataaaaaaaaataaaaatgcatgtagggcagcacttactccggacagtagagcctgtatgagagaaatggagggattcccagtcaaattaatctgctccagcgccctggatgccgccgtcatgtattttgcatggctcattttcatatgcgagcgcaaccgcggcgtcagttgtggctgtcggatccgcgccaggaaaaagatagctttgacgtatacacacacgcggtagtgcaaagaggtctgcctatccagctttccctcaaccagggacaggctcatgtgctccagccccttgaccgagacgtggtcgggccagtgtatgtgcttccccggcgaagtctgatgtaccatatctgcttcaggttaggagcggtccagacaaaaggtcatgttaacacgaacgcttcgacatcatgtagtatgtctctattgagaattcctgtgttgtctcatcttgttcctctaaggcctgcgcgtgtcccgcagacgagactttcgaatcacatgtcgcggttgagagcctgttaaccagcgacagtgcattttccaacacggcgcgctggagcgaagatagatggtcgctgcgctgcagctcttgctgaatgaagcgccgggcttcgttcgctggctgcatcgatgtgtcttctgcggtggctgccgggtgagcggtgctctcgctctctctggctcgcgcgctccaaccctccgagctgggtgcttgcgaggttcgaccgcttcgagcaatgtgctctgcttcctctcgcggatcaaggacaggctgcgaagcgggagcaccggggtgaggattgagaaccaactgctcaaccgacgagagcctctccgacagccttgcaatgctgatggacggcgtattaggcgcagtgaaggatgcgcaggaaccgccccgacttaccgggaaaccctaggacgcatactgcgtcggggccgtgtgcgacgacattctgtgcgcgcatcaacgcagttcatgcacgggtcgtagcggtcacatttcacctgtcctgccttagcattctgtggcagttgatggatgggccgatgactaacctttctgttgtggcagaggtcgcactggacggcggcagcacacatgattagccccaaatcatatcgtagacgacatattacataccgcaggccgctcaggcactatctgggatgccatttccggtcaaatcatgtaaagcggagaggccaagaagaaggtgattcggacagccgaaattccggccaaaaggggtgatggagggggcgggcaggagggagttaaaacggccagcgagggaaacctagaaaactggaagctccgctgcttggctggcctgaccagtagaaagagactatttttttttcttttctttcctttacccggtttcactacctggggatgttgaaatttcactggaaaaaaacacggatgattttattacattacgtaagtaatttaagattccattttaaaactttaattggctaaaatatgctgatatagcgcctgatagagttagtactctaatttacagaccagcgtgttttatgtcttacaaggccaaagatcagttacacgaatttttaagttgaatttacatctcccgactctactgccgaatgcctacagcgtcgcaggtggagccctgtagggcttgcaatttacatatgctgggtcaatgagcttggtaagtaccaagcttccgactatcctttggtggtggagccaatgagagtagacatatatcatgcaaccccgatgtgagtacgagcagggaaactgtgtatgccatcatccatcatgataacttacagctattactttcctacaatcttctcacggtgcctccatcatcagtccacctccttacagaatttaagacggcacgaaaaccggcgtggagccgccctcagggctgctcctctgctgtgttctggccctcttcttcccctatctcgtactccatgcccatctccagggcctcagcgagcaatactgcgccaaacagtatctccatcctccaaacaccatggagacgagatggtccagacttgaagccgcgccggcccgtgggcataggcgacaaggtcgtcgtaatgacgaaactgcaagaagagcacacagaatgggtcaaggaagagctattcgagtcgcttctctccctatttgctttgtcttctcaagcactaaataacacacattctagctgggaccgagcccttaacatcatcaacctatcccgtgaggtcaccgccgaaccagggcagctcataacccccgctccacgggggcaacgaggcaatggcctacctcatctaccagaagaggggtacatcaatctacgctgcaactggaattctgggtgcagggggtactaccagggtaatcggcatgtaacggaggggatttttacggagatttcccagcagacgagcacgctgccgctgagcgcgagcgaagtcagtcagttgaaagagagcatcggcagtatctatgatgagctggtaatccaaacatggtctactaaccccactaaatcactccgtatatactttgaacagggctctacttcgctggccagcttcaggtacctgtttcagtccagatcttcactttgttcttttcatttcacattgcgtaaacggcccctaccacccatagacctcctcaaaatactccaccccagcatactctttcctcgcttcacaaacggccttcctcgcctcgtccgccatccctacaggcccacaaacaaggacagccactctagcacagctgactcttgcctctgcagccgccttggagataatgtcttgagtcggagccctccccttctcaacgacccgcccgcccagggcctcccgatctacaccctcaagtccctgttccctcgaacaatagaaccgcatctgcaccatcgaattcccctcgggcgcagcaagctccctttgacacagctcgccaaacaacgctgcctcccgtactgtccaatgcagatcgatctgctggcttcggccgtagccatccccgccctccccgtctcctcgagatccgccgagtagatcctgcagatacgccgtcgcaacactgatccccgtcccacccgtgatcatgacgacgtgctcgaattcgcccagcgagacccggtgtccgtacggcccctcgatatggagagtcgggtgacaggtataccccgaccgcaggcattgctccttcaaccgcttcgtccagccctcataggggcgacgtagaaggtcaatgtcggcggtgatagtgccgatgtcgagacaacctcgtcttggtagggctggacttgaatctgaccgcctgtcgccacaagctgggccggagccggagccggaaacgtcttcacctgtggccccttctcccccttctcacctgtcataggcatggccacggacccctccatagccggtgttttcacgccatccccggcatatgcccacgaagccagggtaaatggatgattctcccacccgcgccaacttcgcggctggtacaggtaatacacgtcgcccgcccgtggagtccgcgggaccgcggcgggttggatctcaatgcggagaacgtcgctcttgtcactgtagccgacggtgcttcttgccgtgcgagacactctacggcttcgcacgtggatgtttgtaacgactagtcggaggaggcgggcgaggcggtcgaaggaccagattgcgactaccggccagaggtgcggggtgtattctgtgccaaacttggaaatgtggctgtagggttagatgttgttagtgggtgttcggaggggtggggggaggggttggaggaaagagtagacacacatgaataaggcacagacgatgactatggcggagaggatgtggattattaggaagacctcgtagtagcgcttgcggagggtggccgaggagaagggaatgaggagagacatgaggattgtggccttgagtcggggttagttatgatattgtcgtttatgatgtggtatgatgcgtgtgagggggtgaacgtaccacaatgccgaagcggaaccagtttgtttcgaggtccttgtagtacttgctcggggctggggctgttagtcaacatggcatggcatggccgtcgggcttggtgtgtaaagcacatacagtaggccagatatttgacggtgtacgagatagagtgcagaattgcataaatcacagtgactctcgcgagatgccggtggaagaggttgaaggtctgatagtcccagccagttccccagatgaaaatgttgtttcgtccggcaaagagccacagccaggggagacatgcgaaggcgagaaaaccgagtctgggccccatgaacacccagatctggtacgcgaaggtcccgttgctgacagtgttaaatactcctttcagaagactcgatgaaggtatgagacttacaaaggatcgtctcgatagacaccaccgtgtatgtaagccaagataacggccagcgaccagaagaagaagatggtcagaccctgggcccgtaagggtacgttgaagcccagaaggcgtcggtggttgtatcccagagcgggagagagtatcagatacgtatagacagtgtcatgagcccatcgaacgggcgctgggatgatttctcgccagcggcgtgattgaggcttctcgatgtctccggcctggacaccggcacaacgacgggagagggtagagaagacgttttgaacaatccccataaggacgataaagccccagaagccatgaatgccccaagcaatgttgattgagctggtatctctagtctcgttggcagtctatgcggtgagattgacgttcagaagatatcatggggctcgacacttaccacactgcgcacagcgcgcgaatagtacgacttctcaagcagcaccggagtcgaaatctcagtctttcccgcggtgtctgggctgatagcgggcaattgttcaatgtaggctgtagtaacgctggcttcgaggtcatccaagcccgtcagcgaagtcccaagattagcacaaagcttatcccaaaagacaaggccttgactgtatgatgctccatggcagtattccacaacagaggcatagatagaggtaacctcgatttcgttggaacacggagaggctgagttcgagccttctgagctggtttcattcgcagattcctgccagctaagttcagataacgactcgtagatagcatacatgcaatattcagcagcatcggttggtgaaaagcctttggccacaacgtgcgagccaaaggcgagggccaaaattgcccaggaagatttcatcgcgcaagtctttgtcttctacagggccacagtcgctgatgggagatgctaaagcgggagggaaaagactattatttcttaagtagcagcttgaaaatggcttggccatcatttctgttggcaccagcatgcgtatcagatgttgtgggcccagatgtcattgtgtaaaattctgtgctgctctcggggcgaaagagggagatttaccgagcctttgcaggaaggtgggtattggtgctggccgagtggataacgtattccttcctccagatattgcttgatcgtggagtacctgtggtcctgggcgacaagagtcgttgcagactgagagctacgaacataacagagcattatcatcattctacgccgatgaggagcaagaaaaatatgatgcatacgcgaggccaggccacagtgggatccattgctctcagcaagttggttcacagtatgcaatgaaacggagacagacgtaagccggtaaagctgccttaatagccccgtttccgtgcttgggtcaagatccttggccacccacgcccgattcccggcgagagcaagacagcgaggccatggcagcacgctgtgccatgcatatgccagtgtcgtgtgcccctccgattctgtcccaagagggagcacggaggtgctgcctaaatcagatagtcagattagattgataccagaaatcaatcatatcaatcagtgaagctttgccctaataatggggccccgaacttccgacggccgaagcccgactgcgctaggaatctatcgccgaagatcagattaaggatctcttatcaggtaccgaagtccgctgtaacgcccgagataaacggtactacgcgtgtaaagcccgaccggtgtccgaaatcattcagggtccggagccagcagaaaatgatgacaaaatccatccacgatacaagagtgcctggacagacaaagtgggcctttgtggaggctcggttctgagccaagagtagggttggcggagtgtaatttcaatttcatgtaatacatatttgtcaaatttcatgtaacgggttgatattgtgtaagttatcaaacacgctagtttcttcataaattcaccagctctgttaggctggtgtctactctacattagccaatgacaagtcagggttagccccttctattactgatgtaagagatttgtagtagttgttggagtgaaatgtaagtattacagtaatggcttccgaaaatgaaatttcaacatgcctaccctaaccaagagcgcttggagtgatgattatctacccggcctgcccatgggatgggcccattttcaattgccacccccctacgttcacttcaactccacttgcaccgtctgcttctcgacctgtccctcgttaaacagcccgttttgggccgcgcgcacgatctcctccgagttctcctgcatgacgtccagcttcggctttgcataccacttgattcccgggattttcgccagcacaattaggatccgttcgcgcagggaccgcttgcctgaacgctcctcccagagcatgtaggcaacacagaggaggatgcagagccaatagacattgtacgagataatagagccatttgtgccggtattttcccagccaaggatcgcgttaaacacatcccagccgttgtcggtctcggcgttgcagcagttgacgtgccagacagtctcgcggatgtcgtaggagcccggcccactgccctcctctgccatatcggagccaaccgccatctggaactggtagtactgcagatcccagattcccttggagaacatgcctgccgcgatcaggtacagcacgcaggtggacgcgatgaggaagagctggatggacatggcattgccaccgcggtagatcaggtagccgcacgtcacccccgtcagcattcccgtgaagacgggcagggggaatgcagtggccgggtagccgagcgagacgccgccaacgaagacgacggcctcgacgccctcgcgcatggtggtgatgaaggggaggagaaacatggcgtagcggcgagcccagtcgccgagcaacttggactttttgtggttcttgctcttgtcgacgagggccttggcgatcttgactcgccactgctctttggtcttgttgattcgtagcagggctagccccatgatcgtgatgatcacggtcgcgatcagatagaagataccctcccacagctgttcggcattggaccagatgtcatggcccaggccgtagaaaacgccgataaaggcaccgccgatgatcagacgaaagagaatgccgatgagtgagccggcccaaacctggcggacgagccgcttgtagatggactgatcctggtgtggctggcccagactctgcttgaggaaggagagaagcactgagacgatgatgactgcctcgagacactcacggaagacgatgaagaagacctggacggcgaagacgttgaccatgtttgcgcgaacagggaaagaatgtatgaaagctggttgagctgcagaggagctggttcgggagggaggtgattaaatagaccggctaagcgggcttgagtgcctttttgggcatcttatctgatgaaacaagaatatgaggcccaccacgctagaaaatttgcttttggggggccaataagcagggtcaagcaccatctgatatgcccgggctcatttgcccagtggctgaaaaatcccgcgctctgcgccctcgtcgccggtataaaccaccctcttccggaggatggcccttcgtctctcctctctttctctcaccctccccgtctccctttctctcacaataatgctgtctatcttatgctacctactgctggcggccagcgtgccagtctttgccaaagaagtcgtctacgacttcaatgtcacctgggtcacagcgaatcctgatggattggctgaccgccaggtagtcggcatcaacggccaatggccgctgcccatcatcgaggttgacaagggtgatcagttggtggttaacatgtacaatggattagaaaacaagagtgccagtattcacttccacggcatgtaccagaacggaactaatgagatggatgggccttccatggtcacgcaatgtcctgtacctcctggttcgagtattacatataatttcactgtcaaccagaatggcacttactggtatcattgccatactgattactgctatcctgatggataccgtcaggcgcttattgtccatgataacagctcctggtttgccaatgagtacgaggaggagtttaccgtgactctcagtgactggtaccatgagctggctatggacattaagcccgagttcatgtcgctgtataatcccaccggcgccgagcctatccccaactcatggctcttcaatgatactatgaataccactatcgctgtcaagcctaatactacctacctcctccgcctggccaacattgctgccttcacagcccagtacttctacatcgaagaccacccgctcactattgtcgaaattgacggtgtctacactgagcctaccactgcagacatcctctatatcgctgttgctcagcggtactctgtcctctttactaccaaggccacaacagacaagaactaccctattgttactgtcgttgattccaccctccttgacaccattacccctgatctccaactcaacaacaccaactggctccaatatgactcctccgccgcctacccgcaggcaaacatcactgtcgccgaatccgatgacctcgttcccttcgatgacggcaccctggtcccctacgatctcgtccccctcctggaaacccctgacctaaccgtcaacgtcgctgttatcatggaaaaccttgatacaggcatgggctacgccttcctcaataatatcagctatactgcgcccaaagtgcctactctctacactgtcctctctgcggggaccctcgctactgaccctactgtttacggcgactatacccacacgcaagtcctcccgcacaacgccattgtcgaaatcatccttaacaaccaagacaccggctcccaccccttccacctgcacgggcacgtcttccaagtcgtcgcccgctacccagccatgggtccggacttcctgtccctcgccgacgccacagaccccatcgccttcgacccagccaaccacaccagttttcccacctacccgccgcgcggggataccgtcgtcgtcccgccaatgggctacgtcgtcctgcgctttcgcgcggataacccgggcgtctggctcttccactgccacattgactggcacttgatgcaggggctcgccatgacattcgtcgaggcgcccttgctcatccaaaaccggctaagtattcctgccgaccacaaggccgcgtgcgaggcagctggcgtcccgtgggaggggaatgcggcggggaatgtagaggactatcttgatctgaaggggcagaataaacagcccggttggattcccgacgggttcacggcgagaggtatcgtctcgatggtgtttacggtcatcagcgcaattctggggatgggggggattgtgctttatgggctttctgacctgaagttttcgaggaaggaaggtgctgcggatgtacaggcggctgggagtggaaatgcgagccaggatgctgggacccaggaggtatatcaggattagatagccgtggtctctgtacatgcatcgttggcaccaacatcaatgttaatcttgcttggttcctgaatattagagttacagctgtctgctatgattgtctcagacaatatcgaacctcttgttgttgtcctatacaacggaaaagtgaacaaggtactttcgtttgggtttggataggcgaatttttggtgagttagcagcagcgcggtacaggtctctttgaaatgatatcctagggtttgggaaagcctttgctgtagctctgcaagctgcggtacacaagatagtcgctaatgtgaatataaccatccgtgaaattttggcgtctatatcagtgtccattatttatgactccaacgcccttttatcgctccaatcggatttctcgatgctattatagatagcagtaatcatgtctagtaaatctttctatgtaaatttctttcaagactctgtcacagttattgctgcgtcaaataagacatgtttattagaggaaatgtatattgtagagttggtcaattcagcattatcaagctaacgatataatgtattgacgtatgagcagatcaggatgtatgtattttatgcctgatgccgttccgagtagaacctgagtaccaaccgaaacttgactgatggtaagggatactcagtgaactacctctgagtacccgttattgaagcggcctcatttaaataggaaaagtcacgctgagtgtagaaaatcaagtctgtattatagcatataaagactatatcataccaactaaacacattacagatatctcaccacaaagcacattcaaggtatcaatcagtcggcgcaaacttactccacgaccgaattctactcccaaagatatagaatagaatcggcacggggaacaatatggctgtcagacatcccagcagcgtcatggcccacggcacgcccagattatggaactgcatcgtcaatcagtatgtttatttcaccaaagcagccagtaaagctgcagacaagagtgaaaactcaccatgggaatagcaaacatcggaaaccccgcccccagccctgaccgaaagaagcaattggctgcaatagccgagttggcgttgatgttgtagcagtcgatgatatagttcaacccctatacccatatcattagcaccacacacacaccaacaacaaacatagaaaagaagtaaccatacctgcataaaaatcaacaaaatcccagcccccaacaaccccccggaaatggcctgcggtacccaaataatgtgcgggttgctcgtccacccaaaccaaaacatgcccgcaggcaacaacacccctccaatcatcatgggaatgagcctctcctcaggaacaacatgaccctccctctccaacaccttctgaaacctcgtctttgtaaagaacacaataacacagcacccaaacaccaccccaacggcaatcgcaataaacggcaatgcgcccaccccctcattccaccctctcaactcctgaaacgcaaccggatacgcctcaaagcaaagatacaagaacccataaataaaccccatgtacagcgtgatgagtaacaatatcggttcccggacgagcatcaaaaacggcctgatcagataaacagtcgcaatatgcttcagatcaacaggcatctcctccgacctagcatgcagtgcccaattcctcgtctcgaacctcttcctcctcgctctcctttccagtaacgtcggcccaaacgtctccggcacaatcaggaaccccacagccccgaagaaaaatgccataatggcagtgatgtactccgtccaccgccacccaaggtaactcatcgtgatgaacccaccgacaatcgggcccgcgactggtcccacgaacgtagcgcccgcgaacaccgcgatcgcaattccccgttccacaggaccgaataaatccgccagcataccgccgacaatagccagtggcgcgctggcgaacaacccgcccaggaaccgacatatcataatcgtctggagattctgggcgacagcaacagggatctggaatatggcgaagatgaaaaaccccatgaacaggggggttttgcggccgtagagttcggagagagggccgaagaagagcgggccgaaactgtatccgagcacgaagaggctggtgccgaggaccattacctcgtcggagacgtggaattgttgcgcggtcacagtggacgcggtgctgaagacggacgaggcgaaggttaccgagacggtcatgagcccgagaattatggttatgagccatttgcgggggcgggggaagttctgagggttttcctattgttcatagttttgtgagtggttagggttcggtggtggcggtggtttaagctttgagtttgggggtatagatggcatcggggaggagacatactgggtcatcggggccatcccagtccacgatattggggtcgggttctttgtcctttgtgccttcggccatgccaccgtgaagacgctgtttctctatgtcttggtcatcgcgctcgttcggaagggtgctgctggagtgatggctgcgacgggattcttctgccggggaggcagtttgcgtgcgtgtgtcttccatgatggattgacagctactatgagctcgatttgataattcctacagtgcatattgtgtgagcgttgactactgtatttattgttcattatcctaatgtatctggtgggatgatgtcaaagtagacggcgtatccgacggatccggcgacgtcatccacgctggtggcaagctgccatatcgacgctagctattggctcactacttctttcacccatgaacaggtcatgaacaaggcctgcttgtttaatgtacataaggacatctctgcttggactgacatcaccctatctgtcggtgcctggcgacctctattccctaacccgactctcggctctcggctccagatatccgatcccggctggttcaagcattgttggcacatgagaagctgctgctgcggggatggtcgtggattgattttcctgatacgtagaggccaagggcgcactgtttgattagtatacaggtgatgttattgtgatggggatcggttgtatgcttactagacagccacctacgactactaccagcaggttgagaccggtcaacaggatcttgcggcgcgacgaggaatatcggccccagttcaggaacagccagaatattccacttagtccatctataccatgggttagtatagtgatgattctagactcggtaggactcacatgtgaaccaactggcaaagagcgccgtctgcgacagttagccttgttcaaacacacacgcgataagagaacctacgatcaaactcagcagatcgttgaacaccgggatcgcctcagcaataatccacgcaagagtccatagcaccaacccaatcataacccacgttccaatcgaaacaagtccgcgctggtgcatgcggtcggttccccggaacaaacggacgtagatgtatttgcatgccacatgaccattgatcacgccagcgatcacaatctatgttccttatcagcgttgcatgcaactatattcgaaggctaggcttactgtcggaatagcaatgccgtaggcaatcttggacatcagtggactggtcgatcccaatgccggtgatgccacgtccctcccgccatagcggtagataacgaccgccgagatggtgtacatcgacgtatcgatcccctgcagcatgtacaatgtcttggggtagtcggtcggcgtacgcatttctgagatgaatccgaagaaggccacgtgcccggctgtgctggttagctttgtccctctgcctcaaaaagttttatcatataccgtatgcgaagacaatattggtgacagccaggaaagctttgtaaaatgagttgtcaacgatggcatcaacacggccgccacctggcttctgaattgcgattgcaatcatggtgatcagtactgcggcaataatgctgatgaaagctgtcatggtcagcttgctgcattgacaaaaactacataaatgaacctacatgaaatcgaaaaccaagacaccttcttcagcgtccgcggcaaggtgaaggcgaacgacaccgccaagccgatgacgccaaagacaatagaacaggtgccatgatcagttaaggtattcatcatcacagtgaacgtcagaagatgactgcccatgataaagatcagaaacagcagctgcgcagttcccagcacttcgcgaccgatgcgacccatcaggacctcaccggcatcacccatgctgtgcacatgcgggtagcggagtttgaactgtccgagggtatagcccgtgtaagttgccaaagcaccgaggccaaggatgaggatcacggctctatgcaaggcttaagttagccaccaagccacccttagttggtgataccaatcataactcacgcaaccaggccaagcgacgccacggccgaggggagggacaggatgcccagggagattgtctctgcgaccatgactgtacaggtggttagaggtgatctgttggggatactggtatctcatactcattgcacattgcctgaacagttagctaggtccggactgtaagagcggatctagatgaagggatgaacgcttaccaccaggccaaagtgcggtacttcaccccgccgacaccatcgtggctgaaaggatcctcagtcccagtggtgtttctggcaccgacgggtttctcttgctcggcgagcgggtctccagggttattgatcgcactaggcggcgacatggtagcgatcgcaggtgagatgcagtgatcaccgtcacggacaagcaaatgaaccagcgaaaaggagatcagtcacaaccagacaaacgatagtagtgatgatgaggggaggtgaaaacaacagaacaacacagaactgaagatgactgacagaaaggagacagaagccaacaagacaaactctgcagacaaacacagggccctgctggtaaggtcccagggctcctattatggggagagcttatccacttagctcagccaggattttcacctggtgaatacatccgattggagtgtcatctcacgtcatcctaggatgccatctggaattctgggggtggaaatgcgggggttacattcaggatcgaactattcggggaaagccgaaggtatccagtgcctctatccaagcatatcgcggattacggcggacgagcgactacagatgacttgtagagttttcggggatgttcagaacctatcatgtagagccctacagtgtcagaacgatgtaaccctcccaaccaattcggcctcaaggtctgtggatgtcgaagctctagtcctactgctgagtaaggtatttgtcaagccaaaagtaatcgattcaatgcaatcattcaattcgcaataattccaaatcatgtaaaaatctagctaatcaacgcattattccaaatcaagagaccgaaagcagttgtctatgggtattgtgcgcaacgtaagtctatcatctatcgtctatcctctatcctcgtctcgggtcgtatcaaatgatgttatgcttcttgcatcgtcgccaagcacacgcggtcgcgcacatagagttcaatcccagcctcggcacaggcatggtgcagcggctctaccgtctgatacacccggggtttgatcactttctcgccggcggcctccgccggctggtagcccgatgcgtcctcgtcctcctcgtcatgaaagaaaccttcaacatcgagtcgtcgcaaacccttgaattgcgtcttgcgcttgttaaggaccttttgcagctgtccaaccagcatagccaaagagttctccttgcagccttccacatacaacgattcgaccgacgccggaagcacatcagtgagtgggcacgacggttcatactggtagcgaacatcgagcaggttgggcagacggatgcggatatccttcaacgcagtgaactctgtcagaggcccgaaccactcgtcatgcgtttcgttcgctccagcaatggtgaaaggcaagtgggtgccgcaattgtccagccacagggtgtgcaggctgctcttactgctcgcaagggactcgaagaaagcagaaggctggaacccctctgcgagcaggtgtgaatcggaatgctggtacttgaacgattgaagcgaggagcatgaggcgatcaggctctgcatgccctgtgatccgctgctcgtattcagtgtaatctcagcaatggaggaagagccggccgtcggttcctcagcaggtccggttggttcaggctcatcgtcgcgtgggcgggtagactcaaccaccgagtctgccgagaatgcccgcatggatggcaattgaaagaaaggaaggacctgagaaggcaagtagcttcctcggctgtcttcctcgtcagctaaatggctcagcgacacatcgcgcaatacacggaatgccggctggtcgtcaaagggcttctctcccctcactgcccgctgcatcatgcggtccaggtagacattctgcttggggtataccaattgcaaatgcctcaggttgctcgccagcggcaggagaagcgcaatccaggcctcttcaacattatcccggagatcctgctcccatttcgtgtgttcttcagcggtttgactgagggcgtgggccaattgggcaaatggcgccaggtcttcgtcggagaggggggaggaaggagtggaagtggatctaggacaccagtcatggaagtccaaggtgcgaaccgcccgagccagctcgggacgacggagcagagctcccaagaaggaacgggtctgggagcagtccttcaaggctgctgcttggtagaccaagcgcaggaacaggtcgtgaaaatgacggcaaacaaagagaaggttgtagcggtcccgatagtcttccacatactccccgacctggaggagaatgtcattgggaagtgggagagacatagtgaagggggatcagcaattgaaactgaattcaatgcatctgggggaacaaagccaagggagcagccaccggaagtccgggggatttaagggtggccgcacacgtcgataacctaagataggggaactgagttttgcaaaatccacagcgttggtgaactttgccagccttaggatgggagccgatccatcgggcgggccaatggacggcagctggcggaagggtcgtggatcaccagtggcatcggttgacctgctccatccatggttgatccagaagggttccataaggggcaatggagtccgtatcgacacaacccattgtcaacccatccactacaattatttgctgcgaggcatgacgtgccaccgctgtgctgtgtcctccccactgcggatagcatcgtcgggttccgcggttgtaggggcgagaaagcaccgaatccgttgcgaagcggagatcacagtcgcgggggagggcgcatggacgatggcggtggaaaattcgatcacggtgtgtgtacccgcagtcgcttgtcgccaccgccattcaaggcgctgacgggccggtggagtcgcgagacagaggctccatcgcgcgggagggggcaatgctgattcttattttgccggaggtgcaggtggtggaaaattacccctctcggctgttccattgctgcagatggatgcattgttctgcagcctgggagtctgtgtccgttgcgttgacgatcgtggtgatgtagatcaatgggcaggtggcctcgtcgcggggtcaccacagtcctcaggaacgttcaatctctatggaggtacaggtgtagagtagagagagagctgttggctatagtagagtaaatgaagcagttgccctgagctgccgaagagcaaccagcggtatgacggggaagctgtgaggactggaattcgccgatgaaagaaatcctcgactgcctcccctcaatcccgtgatgtcacatgcatgcgatctgcagcccatcctctaccctccaattgcttttgcaaaagtactcaatggctgtctagcaaagcaattcacattgaatgaatcaatcatcacatcaacattgcaaccagccatgaccctcgtggatccgcgattcggcaagcttgctcgatcgggcgaggcgacgctcggtggactctggcttttcgccatcggtggagctcggcggatccccgattgatgaatttccccccgccgatgaagcggtgtttcggatttcaatccttcgaggacctgcttggctggagctctgatggacagcttttactgttatagatgagagctaatagaatggcttttcctaactcgaggaatgcatctgctaccaataaggtgtctattggtacctcaggcaccataacccagaaagttatctgcaagatagtcacggaatatattcggtcttcagtcaggaacagagatatatgatgaccggcttccttttggctttcccgactgcaacctgattagatcctgcacatgtgttgtccgactagacatgcagctagataagtgtgtgtgcggtagcttgcgcttgaatgcagatccacccggtctacttcctcttttaatctcagagatgttactaaactctctacccatgccattaataatgttgaataaacagtgcttctatttatctcgccagctgcggttatggcgctggacatgtgctaggatccatgggatcataccatggcttatacctcgctgcacgagatgatgaagtgatgggtatccatcagatgccaacacacaattagatgatcataggtgtgttagcatttggctggtccgcacgataatcgaataatcacaatactaaataaattaccctcaatcaaggtaaatcggagacagacccccgtagtcttatgatttcatcggtcagttcatatggctgccctcttctcactttctcgcagcccttcctaaacgggtagaagccgatgtggcctcagcgatactggcatagacataagaagtcgaaccttggattataagattgaacatcactactcactgtttcttgtctacttccatatcaagaacatcatgtgatgcctacgatgccacagcatctcattagattacataatattttaatcagcacctcttctccccgcacatcttcaccaaccactgactccacatacgattactgtctcgtgggtgaaatctcaatatagatataaatcactttgccccatatctgttggtgcgggtctaagagattttattacttccttcataatatgcaactcactgctcagttataccttcgaagatgaggaacccttcaactggtccttaaatcatgacgcaaacttaaacaaaccatgcctgtacagctctttctgtcagtgaggcacccttcgacatcatataatgactaactgagattaaaagcaagaattcgactgagttagcttttacattacgcgtctatgcggactacgaaagtccagtgtgaggtgctaaagttcgttcacaaataccagagtataacagctacaaatcaacaagtgactggatgaagggtcagattactatctactgttccctcgagctttccattccattcttggggcttacgactatgcttgcagaggaactagcgcgaccagtatcattgtgaaagtaacattgtattgggaagtctacgcagaattgatactctccttgtgctcgagaagagccgttgccctctcattccggttggggtaccttgtcaaagaccaataatccaaccaccattcgcgagcctcagataaatcaggcatgtactcttgcaacaggtctctccaatctctgtcctcttcccccagaccaatcccagcacaggtaaattcccaccagaccggaaaataccccgaagcctccgagtcaagtatgccagtaagactaccattctcgaccatgatattggcagaagtgagatttccatgcgtaaatgtatacggcgctgcagacggcatgcgttgccgaagtcgctgacgagtctcaacagggacatgttcaagagccacctccaactcggcccaaaggtcgtcgtcagacgccaaagggccgtgtggaatataataaccccttcggaagagaaaagtagaatatattggcttacccccaagggactccatcctgttggaatgcaactcgcgaagctgcattagatagtcagcagtttgtttggctacacgttccttttcatccattttcatgcgcggccagaggctgctgagggggacgccgggaatccgcttcgtcaacacgaagtagtgcccattaggctcctcccaatcttcaaccacgccgggcactgggatcgaggtattttccctcaagaaacgcagattttcggcttcaaagttgggtgcttgattagaacgttccttcagaatcagatctgaacccaaggaccatacgcctctgtcgctcgtcgcatggatgatcttaacgttactttcgtagcggcaaccctcctgtcgttcagtggaccagctgcatgctgaacagggttttgagcagtgctgcatgtcttcggaagaacaaacaagggacgaaagctgattgtagtgaatgattggccaaacaacaaatgggagagaagccaattcaaatcatcggcaatgaatgaacaaaaagacaaagagattcaagggaaaagtgtctgcattttaagccaacttggcgtggtacttatgccatcagtggccaattgttagcggcaatactcagtgatacaaacaaaagagacattcagactatgcgaatactacgactagctagtatatgttccaatttttgcgcgggtgaatacgagacgctgtgaatgaccctctcggcacgtctcagcgcccaatggtgtcacaagccggtgatttgcggtcgtcaggcgaataagatcttcgaaatatggatatagtagataaacatcataacatgaaaaaattatatttattccgattttacgtctattacaactactatgtttccaagtgcaaaaattgaaaatagccgttacaaacgactaaaaacggaaaattgcgtataaaggaagaaatagtcagcagtatatggtatgcatagagtagtggtgaataatacagcctaagagataagaaatcaaagtcattaagctgtcaatattatcattttctcgtaaccttccaggtaccagacactgactaaataatactggcactgactgaagacaggtgtaggttatagggttcatatttgatatgtgaagaggacctggccaatctcacattcacctaagcttatcagggatgcaagctctaagtctgttgactcagaatcctggtcttttaccggctagcctagcggtcattctccggaggatacacaacctgaagcgcaccaggctggatctgacaaacaagaccccgaatttaatcagctgcaaaccaaccagctatactttgaatgactggatttctatcttataactacgagaagtatggactacgctgccacctccaattcagcgggtgtggtgcaacttctgccggtaaatggcgcggttcctgatattctggattcttataaccatactgcgatccgctatgttattcacaaaaaaatctacgacgttatagatatgccgagggctagaacctagggcatatcgagcaatcatctttattgagcaggctatcgctaggactaaatcgcaaataataattgctagaggattcctcccgtcacgccttcttcagataattcaagcagatgatctatcccaagatcaaccattctcaattggaagtgacgatcgagtaacgagactactatagtccaacgaaattgctgctttatataatagcccaaatcaaacgtgtcaatcctccaattgtcgctgttcgaaggaagagtgggaagcggcggcgaaggagaaaagatagtgagggagagggatcgacattgtacgatagcactgtatataagggtccgagctgaagaagatatgaatcagcattaatggtagaaagttgtgagtgtattattattcttgtcttgctccttactggtttacctgtttatatcttttccgtcccgcatgttcccctccactacagcgcaacaatctcatcgtttcactgcctgcagatccgccatatctctatcacactacatcaagcatttctttgcttagaagccctcttagaagggactgatatccacacaagaaacatcatgatggccagaactccaatgcagaagtcaaaataaaggcatacacacctattaaaacctatctctattttttgttcgtatctccttggtggatcacactggaggcaaagtcgacgtttgcgttcttcgtgtcccttccaataatcgcgcattactgggtggccggcaaatttaactcggggacggatcttcagacagcgggggcaggcgaagtggttttcattccttttctcaaaggttagtatacaagacgatgagaagtaaccagggatttatttgcatagatgctttactttctccaattctctgcgacgaaaatgtaggatagcttctgttgcggagtcatagggctctggacttgcacaatagaccggaaatattgacttgtctgtgacaaaaccactagggaaggatagtcaaggtactcgatgacttgaatctgcagctcaggcagcagagtcgtaaggtgatccatggtgaaatgctgtccttcagcttggggtttgagggatgattagacatcgccggctattcattcctttttatgctcgtcgaccgcctataccccgcgcctaatgacctagtagttacttcatgttccatagcactctgtcagtaataggtaatttagcgtagaaaaagagtaaaagcgctttttgattctagtggaaaactattcaaagtattgcacccttggccttgacgtcaccccctgttatataaattcaaagaagccacaaaataccggtatcttcatgtcaggggtatatggaattttgttcgcaatatattcagtgtactcaatagcctcattgttggatttggtagatggaaaatccgagctggtggtagaataaatcatataaatcagtgatattttaagttgaggctgcttatcgtaggcccgcagcatgttccgcatttcccgagctttacgtaccggccacctggtttgtagataattagaatacaatagctttggctttatctacactcaggggctcgcttgactatttttcttactctcggatcaacagtccattataaatcaccagcactctttttccgggctgtcagatcttctgaagctctgaaatgaccgagaaatcaacatacaaatctagcaatacttatgaatccgaactctcaaaagatagacgacgagagaaaactgccaagagaaaatggtctctggtctcttgaagcgctcgaatctagctgccgtaatcttccaccgataaaccccttagaagggagtctggaaccactccgttgtttgtcgcaagcctttcggtgatggttctgtggagagctacgtttcgcgacgcactgccattttctccgaccaagatattccatctttgtgctagtctctttcttgctccgggcgatgaatctagattcaatattttgagcaaatcaacaacagaattttgccagtccatgtttggttgtccatattcggcggctttgctggtcaatagaactctcaaattttctctattcattctagattggtcccttatttgagttccgtctgaagagtgtgagaaaatgcatttggttaggtaaggaagtgtgcggtacttacagctgatcgaattgctcccatctaaacatgctaggagttcctttgctgccgccgcagcggttgctgctgcataaccctgccaaacgtcgttcttgtcggcatttgcccagtcactgattcctcttatcactgcaactggtaaggtattcatcattccagctgcttccatttcaatcgcaatggccttgtattcacgggctaactcgtcgcgtagatcggcagacttaataacactgttcccagacagaatacagccatagtggaataaaggctcacgttgctccccaaatgacccacagaggacattggctggtgccacaaattgttgagggaagcttgtccctttgaacctctggagatttagtttgaatcttgtaggcgtctcctgggaagcccggaaattggtcattgcggagcgtatatgccgatcgggtgcattctgccattgcttgagaacgatcttctccggctcgactttgaccatatcgtaccctaaaacgccggagttgttctcagttggagtagcgatcaccacatcacctagacgcagatcatgcccatatcgaggtatacctgcacctacaccaacgaggaggccagtcttgacgttaggcaagtcacgctggacctccgaggccatgtagccggcaacgccaattccgatttctccatctgggaagaaagcgattgcaacgttggtcctgcccatccgcccaaacctgtagcatagctgttggcctctattcggaacaggactcacgtggtgttcgtctagcatgagaagggcagcgctagcctcaaaatgcaagggagagaaccatgctactgtatagtcttccgcagttagacaaagggacatattcagagaatctgctggaataattctatggagagaaaaaggagcgatcggtgagctagctaacttggaagcaagtatgacacgcttataacaatcgagactcactatgaaaagggtgttagcgctatgttatcaatccatctgcacagcccattcgcttggaaatgatagtaccccgcccgaggcgtagatggcctgcgtgcatatcttctggctgtgttggcgcgagtagaagcgccaaacgtttgatagacgggaaacgagcgctatctcagccgaaggtattgtacagccttgtgcttgatcacaaggctgaagtgacgtagcctttcaacgtgtgcattttatacaatcacctactggctgatatcaagacaggggtcttgaggggggttgacgtgtcattatttccgcctatgaggcctcctggagccagataggggccattgcgcgccatcaaacaacagaaaggcaaccctctgaggctgagcagatcatgatatatatgaggggacataagaaaccttgcctggccgctgaagccgcttagaaaggcatattatccatatacttcttttagcttgccggccatagacacagccttccaaccacagggacactctctacgcttaccttaccatggagtccaactcagcacgcagctctagatgcctccaggccatacggagcagaagtggcaccaaggccaatgtcattcttctggttggcagactaggcgctgggaaatccacattgaccgagcttatcacgggagccgaggggctgtcaaatggcggaatccactcatgtaggtcttcattttgagcaagtcaatagaatcccaaattgactctcacaagcgaccgatctgtgtcagattttcgatacgactatcagcaaggaagagtacttcatcgttgatacacctggcttcgagcctaacaacaaaggggaaatattccttcaagttacggagatgttacaacagctacaaccaaactccattttcggtatctggtacttggtcaacaactataccagacaagacgggtttgacagagagatggtagcctggttgacgtctttttgtggccagtcattctgcccagacgtgacaatcgtgaccaccttttggacagggaatggtgctatgctaaggcatcagaatgataaactccagcagcgactgaatgaggaatgggcccaactacggtcatggggagctcaacactatgcctttgggaggaattatgtcgatgacgttcctcaggagagtagtatttccctgttcgagccaactcaaaaagaggagctagagcagcaagccaaaagcatggttacacgttactgtcataaagaatcgacaatataccctcagatacttcgggagctcggcgagctacgaccattgcacggtaccagtgctggcaggatattcctccctccaagtcaacaggcaccgagaagtgcttcggtccaggatacagctgcatcaagtagtgcctcagttgctgagccacatgtgccacgacaagaaaggaaggaacttcatggtggtcctttaccatagaggcattgcgacctgtattcgtgaaaggatcgaatttggcagtggatgcagctataggatactttacaaggagtcccgtggtttatggtggccctggaggctccaatctcgatccactttcttcacgtgatacagccgtgaagtatggtcgttccggcgacttcgattcccgagcaggatactataattcatggggtatgaactcccagtacggggaattcaaaggtacggcagagcaaggtgatgctcttcgcagagagatgcacaagagatggggctaatgatatgcaaacgtgtgatggatcgatttgacgcggaatttcaagtttttatgtttgataatgtccataaaggactttttagtgtacgagaaaacgtgcgtcggtggctaggcaggaaaggaggatgatagtagtgtcaggggcagatcttctattcaactgcttgatttgattatacgcaagagcattgttttgaccttccaagggcctccttattcggggcagttgactctatttccggaaggcgtcatccttaaaaatcaacaggccagatcccggatttatttatcgttcgtagtcaacgcgcagcgggtatcaacacattttcaatcagaggtctcccctagcgaggcatatcatcaactcttcgctagcttcgctacctcttgctacgcccctctcattaaaaatactgatccctcccatttcgacggtatagaaataaacaaagccgggcacctacctgtatgcgggggcgattgccgtataagctcgtgcagatgcggaaacaaatgttattcatatcgtgaaattcccgggcctacatagtagattcttgacacaagttgcaagatgactttaattttcacggtgagacaattatataaattaaacacattaggaatctcagaaaactatgttctttcaagctatgcatacatctctcaatcctcttcctcgtcagcaaactcccaaaacgtaacctcacccgactcattcctcataaccaaaacattttctttagttacaaccacatcatgcggtctgtactgcaaaggaaggagaactttttctgacccataaataatccagccgttcttcacctgtatctgccgactggttctcgagtcccactttggtagaaacgatttaacgtcaattcgattttcatgtgtaataaccacctcatcgccttcaaatttcaacatctttgatccaactacgctccacttcaagttcatgccgttgtgctggccaagcagagttagattgtttccaacgttttcccacaagtagaggattcttccatcgaggtctctagtcgcaaccagcctctggtctggggacagtgcagcacagacccccggatactcaagaagtactgagttatctttcgccaaatcgtacaagaaaatgcgggccttgttgcgttgcttccaaaaggggatgggacagtcgattgccacttttgttccgttggctgaccagtgaacctttatagcttctaattcctcgtgaagacccgtagctcgttgaattcgaaaatctccttcaattacatcccatacttcgagggttgttgctttggaatccctatctgtatgaccaattgccagaagcctaccgtcaggagagaatgacagataaggatctccattgtatccgcgaggaatggcggaagccacgacgccagtgattacatcccgtactgtgatgtaaacattatcgtcatcgtaatgagcgctttccgttgagaaccaagcttttgcaagaagtctgccgtttgagctgatttcctttatctgattatcgacgaaatagccgtgaaaaaggtcatctaaaagctggttggtgttcatttcctgtactgccgtctgtatatttgtcaaaattggacctttgtagtccctgatcaggacttgcccaaacatttcagcaaggccttctatatctttcctgctgactacccgcataagagagccaggtctatttttccaaagatagatatggtttgtggatgccgagagtacaaattgatgatcatgggacaaaatgagcctcccgtcagacttcagcggagctgcaagttgttccgatctcaaatctgaagatagatcccaaactcgaattatccctttcatatcagcggatatgagaactcgactttctgagttgaacacaaagctcgggtcatccttaatgcctctcaaactcgtcaaacattcgcctgttgccgagtcataaagcttagtgatgggagtgcgatctgcctgtgccgttgcgacaacaaatatcttcccgcttggcgagagtgtaacgcgagctttcgaatcgggcgtagggatcttcaccaagcgttggccagtctcataatcccatctctgaagccctgtggaacgatgccaggttgttacagccttttcgcttggggagaaatgcattatggtgtctgagtcgagggacttgcagcctttccagtctagcgaatcatcaattatcttcaacaataacgtcttcgtcctccattcccatagctgaagcaaaacacaatcttccaatagtgtttctgtcaacaattcaccagtagcggagaatgtcatattgaggccctttaccttcccaatccctgaattataattcagcgattgtatgaatttggactcacttgcatcccagaatgttatgctaccattagttagaaaaattgccaaggtggatccatctgcagaccatgcgatggtctttactgtggtagaaacatgaatcattttcagtgttccctgtgctgcataggtcaaaccaatggtcattttattggggtgtaccactgctaggcaccctcgagatgagagtgaatctctctgagcccgtccccacaatccgccatcggaggcatcttttttcccaaagaggatcgttctgagcaacatccctgaacctatatcccatactcggataccctccaaccccccagaggatagaatgtgcttgtcaccaggaagaaacgcaataaactcaggccacccaccgcagtcaatcgtatatagcaatgttcctgtagttatattccacaacttaatcctgtagcgcttccagtacccgcacaagacagcaagagtcttcccatccgaagacatggctagacaatggctggattctctgttatcgagttcttgaagtagaggatcccatttctccttcactttaggcaatctggagtagatttttggaatcgaactctgaaatgtctttcggcagatgctctgtttcggagcgaaaatgagtgccgaacgataaacctgaaggggggcattttctatttcgttcttggatgcgagcatgaaacgcttcatgtcagataccatatcttgaagtccggctctcccatcgcgctagaattgagtggaataatatatagtgattagccaaataagttaataaaagaatacgaattatttgatacctaccggtagggacgcaaagtaactttcaagctggatggtgttaacaatagctgtcggtatcatttgaagaaggctcatgacctcgagccaacacagaaaatgcttctggagaaactcatgtacgcagtcattatcaagtagcttgactccagcttgttggagatgatgcgaccaatattgagaagcatatctgacggaaactcgaacatgtcggtccagcaaagatgaaccaatatctttggccaggaaggatgggtcctcaagagaacaaatgtcttgcttcagagtactcgacagcggctttaagcaactctcgaaaagggccctatgggcctttcttgggtcaatgcagaattcatcgtagagacatctcctgttgggttggccaacgagaaagtcgcgaaaagacatgtgtagcaattgaataggtgatccaaaactgaccccacaagatatgacagagcttaaactgttcaaaagtcttcgagttttggtttcctttccagcaaaatccaagaggtcttcgagggtcgcgatcgtgagaggctctgctagtacaacaacagctccgatcattcgttcaaagagctcatagaaatctttcttctcgctctttatttttctcgagctatacattatagagtattttaggatttggttgtacatctgatccaaattgtcctgtggtgaatctacttctgagctgtaaccagatatttctcgcatgcgtgcttgcaaatcgtcgaagtcgcagtctaccccatccaaaaagcggcatgcggtggctgcataaatgaacaaaccatcgcttttatcggcaagagctcggacaaccttcctttcttcatcttgactgagccagcaggtagattttgctagcgactcagagtagttgacggtggcttgggatacaattcgcttaacctgatgctccaaatagaaggttatgtcgtctttcggaagattagccccttcggacattactgggatttttcgaagttcaaagtcgtggacattagcttctttataaggaacataaaattgagaccgtagttctggcctgctggtaaggaatattttcagtcgaatattttgcaacttttctgctgtggttataagcgttaggacgcctccaatatcatgggctggttccccagcctccttggggtcctgagacacagactcgtcaagtgcatctagcaccaataccagtgtcacgggtaggagaagttccttatcgagtgtcaaaagtggctctgaaatcaatttgctccattggttatgcaaattttgattgccgatggattggttgtccagaattgcttggcatatcttgtctctagaatctgggaatgaatatgctagcttattggatatggaaggaaacaacttctcaacggagttgcgccccggcttagttcgatcaaagaagaaactggcaccgagacagacgttcacgggaagagggggcccgttgggaataagtgatttgccttgctggcacgcagcagcaagggtacgagagattgtagatttgccggttcctgccattcctctgagccagaatatctgagagtcatccggagactcaatccaagtctgaatctcacgaagtattttcgtctgggtgccctcgaggcattctggtttgttttgatcagcaagggacccaaacgttgcctctccgaccagcggaagcaatttgagaagctctatttgtttagtctcctgtcattatcactgcgcgtcagtagggccctattgctcagatggccatggttgtatctacctcaacattttcctttatcacagagagtgagtccattacaacccgttgtgaattctccagttccttgaggatcttttggatatcatctccagcgaatgttgccaaatactgaccaatgctctcatcgagactcgtgatcgactttagcatgctgtgccacttatcgatctctgtccagtcgtgtaagaatcgcctgaacccggcatgatcgaagtgcgtggcaagagacatgtggtactcaagtataagaacgtacagctcaaccgttttggatctgattaaattagcaaaatcatgacccgggtcggctaccgtgaagctggaattcgagtatattttggcctgacttctctccaggaatgcatgccgaaccataaggtctgatacagcttgaaaaccgttcatagcatcctcatcctgatcaaatgatttggccaacggatacagtaaaaacaaaacgcctgcccatgctatggagacatgtggctccgcactcactgccgcggtaatgatatctttcacggacagtatcccccctacaacacgacggacttgcttcttgacttctatttcttttcctccaatgcgtatcttgcaccgtaacttttcgatcgcttcaagacgcctttttacgcaagtctcaagtcgaggatcaatgtcaatattgtctccttggttctcattgctcgagtcatccaattccgcgttcgacaggaggatcttttcatactgggcaagtaggtcagggttcttattttggaggtccgagtaagctttcttccacagcccttcgagccttaaagggataggattgggaacgttcgaggggcaagcatgagggactgagatatcattgttttgcgatgacaccaccgatgcagtacttgtatcttgagaaacatcaagaccggagtttcttggcggacggagagtcgccgtccagtctttcaggcgctttcggaaatgcattttttttttttttttcgacagtggcagtcaccgatacgaaaatgtttgagaagggcaaaagcgaggcaaagatggcttcagaggctggacaccttacccctcaccctagcttgcgtttgctcgcttaacaagactagtaaggtttccgttctcaccagcaactgtatgtcaggctgtgtgtttctgatgtgtctcgatatcattggcaacggtccacactagccttgtcacttatgcatggtgccgatgggcgtagaacctatggcagatgctatatagacagccaaacgctggctaagaaacgtgaaattgcaaaacaaatccaaggttcccttgatgttcctagataagtagcacgagatatcccaagtcaggcataccctttcaatatccgaagccatactgaacaaagagcgccaacagcaccttagacagtaacggctcaacatccattcatatccaatcaatctgtatctgccgcattccctccaattctatcttgccctctctataccttggatcattcatgctgacaatgcctcggtgttccaagtcatccaaaagctcgagaatgtagatctgagagttatagctcggatcctgattatcgatctctgcccattccccagcgtcgatgatatcatcgtacacattctgtgcattcggaatatcacacagattaactcgtttgatgatccttctttcatcatttctcgtcaagaatcgtgcttcgactcggtaatacgttggagatccgacgaggtggaccataggcttttcggtccaggttggggcgtcgatgcaaagaatccagtgcttgagttcgccatctccaggtactataatgacatacaggtaacaggttgccagagttggtaggtcatctaagtagatatagttctcttcgggctggccgttcgagaggtcactgtcctcagagccctcagagtcctcagagtcctcataatgctcggactcctcgttgttctccatgatggaggtggatgggctagtttaaaatgatgatgtgacaggctgatgaaggacagaaagtagaccaaaatgaagcgtagacatgtagtggagtatgccgacggacgcaagaaatataggatggtttggtagcaagatctgcagattgtaggcaaggctaagatggatcaaccgagcgtggtcatccaagagacagatgcatctcacagatagcggggttaaataggcatcagactgagaaaaatcctaactcatttggttgtggaacaattgtcatacagaggaggggatcatgtgactgcattcggagatgccaggctgagatatcacttcccgaactaaccattcgcaattctcctcgacagtcctctcatcatgacctggaggtaccacctgtcaccccaactatccagacggctttactacagtcgatccctgttccattgtcttctctggcccgtgcgaaactactctcaatgtaatctccctctccttgatccagctgaaaagatcgagaaagaaatcctgctatagtactcacccgatagcttctaccctgtaagaattagcgagatactccattgcggtatcaagttgttggtaaactgggctacggggggtattcaactttttggctatacaggcaactattgctagccaaaatttaccccaatctacagcccatacgagaaatcttacctatctaagccatgtaggcagcacagatgtatgtcacgctaagaatgtttttcgtcggggattcaagaacaggattgacaacttagaacgttgatgtagcagtacacgagacaaacaaaggagcaccagtagcatagggtgtcagaagtgggcttgcttgggggtaaaatagccactaaacttttgctattatctggggggagaatctgcaatgacatggggcatagatgaagaccacactataagcagtcaggattcccctaccatgtctatccttaatgtaacagccctaattggatgtagttttgagaacccatctacgcatgatttgatattgcttaacgaatggatcccgtaactgtcacagtgttggacatgttgacaatgccagtattggccgagcgcttcggggtaggcatacggacgtgactgataagctctgaacttttgaataggtgcgtagcaattcgctcccaaaagctgagttaaccaccattttctcgcagtagcgagaagtagtgatcatcaggctcttcccacctcaaatcgcccaacttcagggcagttgactatgggatatgttcggatacgcaagtcatgtgatggtaactgcgggtccaaagatgcacaagaccgcatcacgtcagcattgctgagtcatcccctacagcgtgcatgttgacctggcggacataaggtcgcgtatcccctagtattcatcatccatcaaacctgtcatcatggcatcgatgttccgccttccatctcggctatccaggcatctttactcctggagatctttgctccaacggcccccatcgccagtgcgcgatttctcccagtcaaactttcctctcctcgatgcaagtgagaaggtcgaggaggagacgttgtcctggtactctcccgatgacttctatcccgtgaagattggcgaagtcttccaatctcggtatcaggttattgggaaattgggttacggcggatattcaactgtttggctttgccgggacctccagtcagcttaccctgcatacaatatgagctgcggcgcgaaacaagactcactgtagttctaggcagcacgcttatgtcacactgaaggtatttgagcgcaattcaacagaaggccaacgagagagggaagcctacagccatttgaattctcttagcatagcagaccatgctggtgtacagcttattcgtaaagcattggatagctttcacatcacttccgagaaaggcactttcggatgcctggttcacccgccgctaggaatgagtcttcatgagtttcgcactcagctcagggccaaagtacttcctgaaaagatagtcaagttaaccctggtgcatctccttcttgctttggactatctccatgcggaagctggaattgtccatacaggtatactagtccctcctgtaaccccttcagaagggctcctaattgaataattctctccagatcttcaagaaaagaacatcatgatggccatagaagacaattctatcttgtcagatttcgaagaagacgagaagtccaatcccagcccacgcaaagttgtgggcgatcgagtgatctatgcctctcgcaacctcaggaaaaccaaacaacatggccgtcctacgctgtgtgacttcggtcaggctcgcttcgggtcaagtacttattccggagatattcagccctatatctatcgggctcctgaggtggttttgcagatgccttggaatgagaaggttgatatctggaatgtcggtgtactggtatgcatccttctcaaccgtctggctgttcggctagtactatgactatgggcgttcgtgcgatgtactaattgaattatgcaacagacatgggatatcttccaacagggacatctgttctacgctagagattcagataagaaatgctccgatgctcatcatctcgctgagatggtggctatcatgggagcacctccaaaagaaatgattcagaacaatgactatgcaagccaattcttcgatgacgaaggtatgggtggatttcgatatctcaaaaatcttgcttttgctgactgtgagctaggaaattggaaaggggctaccgaaattcctcccgtgtctttggaaaatctcgaagaaatcttggagggagaatcgcgccagctttttctgcagttcctgcgcaagatgctcaaatggaagcccgaggagagggaatcggcgagggaccttttggacgatccatggctacgctcgccttgaaacgaatctgtatacccagcaacccaagttcaaatgacacgctagtttttcagtgctagctacgcaggacgtaagaaaatgcgtgaacgataacctcaagctctcacaatatcaattaaccaaagatccaagtaattccagcagcggcagtacccaaaacaagaaattcaaagagcataaccctatcaatacaaatagtgggaaggacctcgccaagtctcccaagacggcatccttacccatccaactggtctcgagtaattgaccccaacaagcacactaaacatcaattcgtttgaccgagccatcttgatgtatgtgcagtctccggaaagttttcaggccatcatccttgatacggacggacacaacatctttcgggtcggtcggatcatcgtgggaagcatgtggcttagagcctctatgaaaagtgattagctctgaactcacaattgtcccagaattccgttggggagtctgagggttaccggatctcagcattcttgaacctggggtcctatggcgcacgcatcagtacttggtacaaagccaaagatggaatacatcaactcacactcttttcttcagcgtcaaggacctgtccgacaggagcctgccattcgggaggaaggtcacccaatcttgtcttcccaataagttggtacaaagaacgtgctgttgctttgaacattgcgaaggagttttcgaaataggtctgcttgcgttttgcgttctgggataagaataatattttatggaagggtgtttgtttgcttgcttgatggagaggaaggagcaggtttaaggaagggctatttgtatgtcaataatgtatggatggtaggtgcctaggattagcagcacccctcaaatgcaacccaggcgctaaaggatacactataacgaacaaaagatagccaatgatccaataaacttacatacgaaccgcacagctgaagttaatcgtcgtcgtcatatgctcgtttagccgccagacaccgattacatgccaccgaatcgataggctgatagcaactttattcaagagggctgagggctcaagattttgcatgatggggaattgaatgtagaccggcgcttagtagcaagtcgctgagtgtatgataggctacttagaatagaattgtatatcagacaccccaaatggtaggatagattatagcgccgcctcagaatctgacacaaggctcacgaactgttaataaaaaatgtgtacttagtttgctcgtagtttcagcctcacgaacaagcagcgcttaaatctggcttggagtgtgcggtcttagttctaactggaccatcttctactgggaagaaacactgccacactatcacccctgccgttcagctcctggagcctaagcttcttggtacaaacagtcatattgaaccgtgcaatccgtactatcaatccgcagacgatgtgtgtacctgttatataacagatgcatccactgatgtcgctggtgcgttcattgagatgtaacatgaagccattcctatgattgggtccagttaaagtagcagcgttaacggtgggtgacaatcagtacttactaccatccaagaggtaggacactcttgattggcgatgacaccatccccgcaaataccaatgtatttggtgattatttcgtagccataatatagactgggttgggagaagcataaaagaactaaaccctccctcgagtaacatctgcgatattactgggacacgtggtaatctcagacgccatgcaggtagtagctgtcaactaacttgctaatacgactcagtggttagcttgtgttgcatattcatgcctttactctcagcaaccatcccacaaggggcttgctggatgggtctgcgacagtcatttaattaccacatgcagtagtgtacgagatggaaagatcgctagagaggtcgtcgagcgagtgctgtggtatctggctttgcaccttgcccaatcggagttggcaaactggactctgtacaatgcattttactcccggttgattcatctacattccgtaagcgtgtatttaaagagcggcgacggtctcttctggagtagtcaccttgagccttttcttcgattccctttatttctcttcatctgcctgagattcttttaatttgattctatgtacattgactaaataccaatctctccttttccagatacggccgtacttgcatcattgactcttcgactataggcgaagtatgttgctgctttgcttcttgttgctggtcttttcggggtctaagtctatatgactaggcactttggacaatatctttcttcttcttcagacgacttatgtatttaaatggtgagtactaggttagctggctctaagagtcagcgaaatgctgaattatcatgacaacatatttatcttggttcaatcaaacaaatagagaaaccctgaggcctttgtgcactgagaagacattcttctcaaagatatagaaatagcggccgagtcagaatatgagaagcatttgaagtacaaattgcttcatagttgctttgagatatcagcaatggctagcttggcttgtgagaggtcttttgaatactttgtaacgtcgaatgatttgacggtaaaactggcggtcaacagccctcttcttctctcagggtagcggtcaaatttctgcgagataaaataagcaaattcggggaaatgattactgagattacaaatccaccttcataaaagctgagtggaagtttagatgccttatcaagtgcatctctccttgtaatctctgcgcatgggagagagttgacgaggcaccagtcctctcagttgttggttttgggtgaggctctgcttggttatgtagcatgaaccaagtagaatgacagatattaggccgggctggattggtcaagcgcttggacaccgggtaatatgtccggagtatgggcagagacagatcgccagacgatgtacgcacgatatgatatttggcaacatgtggcgagctgaaatggttgcaagaaagcgccaactgatctgcttatggcttagcgctcaccatctgttcacaatctgcacttcggacaaccactcagagagggtttgtcgttggatcgacagccatttagtcaccgcatgcagtagcgaacgaactaagataaggccccaaggcgtcagctgctgtagacggctctgcgccgtgtccaataataactggctaacaattgtgacacaatgcgacctctcaatcaagtgacctgatcaaatagtgtgatcataagtaagggcagtggtcccttcgggactttttgtgggtgcagtgccccatagtccaagagcggattgaccttctctcctcacctatcatgaaaagagtggccatcgttggagctgggccctgtggcttagtagcattgaaagagatgctgcaagcaggtctcgacgcaaccatatatgaaagttccaatcagctgggtggtctgttcgccacagcaatggcttatccgaacctccacctcacgatctccaacagggcgatggctttctcggactttcctgatccatctcgcatgcgatgttccacggccagggattatttgctatatctgcaagattatgctcgccatttcgatctcgaacgtcatatcaggtatcgctcggaagtttgtaaggccactcgcggagacgataaacaatggaatctgtcgatcaagcagacaagagacgatgagaacgatgaatccatcattcaattgcaggcagacgcccttattgttgcaacagggggtagccaagttccgaatgatgtaccttcacagctggcgggattcgagggcaagattatccattccaacgcgtacgacaaatattttatgcgggaagtcgcggaaaagaagcttagggtcctgatcgtaggaggcggcgaaagcggtgccgatatctcagcagacctttgtgagttgtcgcctaatctgacggtttggttgcgacgtccaccctgtgtggccattcgctaccttaacaggcttgatgagatgcaacaaatgagagccaaccaaaccgtggacttcccggtcagcatcttcctcgaagccatcactacaaatcgcctgggtgcagcacaaaacgtttatctttatagcttgttccgtcgtgccgtcttctataatggcctaatcatgtccacaagagagcgctggtttttggaaaggttggcaacggcgttcctccgcagtgatcaatccacagttatcacgaaaagttcgcgaatgtgtcaggctttagacaaagagaaattagaagcattaataaccccgtttgtctctgttagtgggcggacctgtgaatttagccttccagatgggacaaggcaacggcgcgagtttgatgccatcttgctttgtcatggcttccgattggaatttccttggcttcagctccctgacggtattcccttctcgcctaacccacgatcatggttcctgcattgcttccccgaggagctgggcgactgtcttttctttttgggctatgcacggcctggccagggaggcattcctcctgctgccgagatgctgagccgatatatcgcattgttactgcgtgacgaaagacagcttcccgctgattatgcagaacaggcacgaaaagatgaggccgctgagcgtgagtattactatatcagccccgaagtcaattcgctggttgattataatgcgttcatggaaagtgtggcacgaaggatagggtgtgaggcccgaatgccgctttcctgcgtgatctttttcaatcttcatatcctaaccgttgctattatggcccttcgctggttctcgaaaacattgatcccattcggtatttcgactttgctgatgctgtgggttggaacagccatcggactatgcatgcttcatgatggactcatcctcaagtggtggctgtatccccactggggcgtatggtaccgctaccgtggcccgggtgccaatcctgccctactcactgcgcttctgactcggctgagcctgcggcaatcgattgccttgaacccaatatacattacctacctcgtatggttcatcttatcgacctatattcagcgcctgctcttgatatacctgtttgtgcccagtgcggtactatctgcattgggtgtgcgtttcccggaagggtggggaggcctgctacgcccaaaactttttgttttgcacagctgcgaatggcgtttctctgacctcttccttccataactggaacttatcctatgccagtatcagctgatgtcaacaacggacctaatcacactttatataccttgacgttattagcaaaattgcctgatggggaaactcggctactggatctgttgctcttaaaaaaggcttcatgatttggctttgggtgtttgctccaaactgttcagtatccatggtaaatccaactatatgtcatttgggtgctgcctcgcacaagacagtatattgttgtatcttaaatttagacttgtatactgcggctgtcttctaaaatcgttactctgtgctcgaaagtgtgtagtattaatgccatacttgggtctagaggctactggcggccattatttggaaatactgaagtcatagtaatcattgagtggctaagcaggcctgcttgagaagactgacttcgtaccagataaagagtatatgcttagagacgcgtctgtggtggtgttgtactggatgggatgttgatgtgaatgacatgatcgagtggggtaaagcagaggctctctggcggcagtccaaggcaaacaacactggcctcagaccacgtagtacacgcaatgcactacacggagatacttccgactcgttggccttttgtaattatcacattcgtctatgtggctaagtacttgacaggaactttcaacggcacattgaatgtcacaggctgtgggatgataccacatatctgtgattcagtgccagataataggagaccagaatcagagaccttattctcttatgtccttgaccgttagattttccagcaagctccgcacaattcagactgcatttccccgaatcaatcctcgaaagccatcatgtaaaaacgcctggtccagaaataaagaaaagtagaggacggagcttgctaaaaacccgtacatgaaaatccgtcaatatgcctctttctgagcacctttccaatgtgcgcgtatcttatcgggaagagttattggtatatgtgtcttcatttgcctggtatagcgcccgattccgtctatcgtagtcccaggtccgtcatttccacactgtccgcagagcccatccagaggatgttgttacacctatcagcgtattgcgttagcaaatgtccttccaatatgcgtccaagtgtatctccgaagaggggtaacggatgcgcagatcccagcactgctatcaggaaaccccagcccccgagatatcaggcgaccgagtaaacgcacctaatcaggaccagacccaatgttcccgtgttctttccatcaatgaactcttccgtatcacggagcagcacgttcatgtacgaatcgatgctctcaagcttgcccttgtattccgtttggccccacttcagacggatgatgagctcggtaccgactctgcgatttgaattagaggatatttttcaatagaaattggaagttataggataggattgcggcggggcgatcaagcgacaagggaccgggtgcgtacctagcctggaggaaaggccgggggttgacagggttgaactagattcgcagagtcagtttactccttattaacaaaagtgtacgcctgaagataaagcttgagtcaatggagtagggataggagagtacgaacactcatggttggtggtctgaaatcaatgccagctgctcagcaggagtttgcaaaatatggatgtcgatggagatggacgcgccaaaggaatcgtgtaatgatggaaataaaaaatgaccgtctccacgtccaggtgaaattgagttgatcgcgtgctgtaaaagagctgggcagtctatcggagatcgcagagccaacttgacggagctgatgccgtccgcgaaaatgtgatgccgccagacgcgggtatcacccaatcacaagctgcacaaagacaccgccttgtgagtactgcaatatcgctccgcatttcatcagcttcaatgtgcacccaccgggtcagttgctctctttctctctctggaggtggtatttcgctgtatatggcaatatccgggcctgaaaccttgttcagatcaggtggtttaaaataggcatagttttccatccccatcctaatcctgtacagccatacacagcatcaaagaaatcttaggctctatcgtcgcttacacaggctaaactacactccatttctcattaaatgataatacaagaaacacttgtgatttccgtcccttatgcccttccgacctgaaagttgatctccttgatcgaaacctcctctcccgccttctcatcgtaatcataccactcttcctctgacaaatcaatgccggtgaaaggagtagaagactcagctcccttcgcttcccactcaccctgataagtcgttagctgctgctatcccttggtaacccaacaaagagcactgtaaagaaccacaaaagtctcaaaagaaggagaaagaaaaagaaaaggacgatttaaccacttacatcagccttaaactcggtaaattccaatcctctgcagtcaatctcaatcaccttcttcgcagtgcgcttctcatccgcctcgtagacgttggggccggcagtgatagaggcagagtgggttttctagtaccaatcaatattagtttacacatcatcccgatgtttcagtattctcagttgcgagaatgaagttagaaaggagaagtcaacccacctggcacagcttgcatttccagacaaagttcgcctcgcccctactaccggggatttcatgttgttcctggatacagagtaagtttcccgttcagagaatctataggatgggggagatgaagcggacttacgaagcggttgaagctgacccagttggggtgggtttcacgacaagaggtgcattgcactttgaaagtgaagtagtagggctcttcctcggtgtccttgggacggaggtcggtgacgctattggaggtgaagatatgtgagttggagttggtttgagatgaggtgcggggaaggatctctgcggaggggaaacattaaatgacctttgggggtttgactgaagggatagataggtgaaagggccagttagtaatataagaacaagacatacccgctgagttcggcagacaggaggagggaaagcatcttggctgtgtttgttgcttgagcgcgagagtgttgatatggaggaaggaagttcttcagtgcggggccgtgatgtcgggtttcggaagcacacataaagactctaccgccctcccgcctgctgcccttttcacttcagtgtcacattcgtgtgtttgttaaaattgtcaacgttaacgtgaaccatgtttattcattctggttattctgagctattccgcagggtcatgaagccagaaaccaatcttagcaacactatgtgatatgttttccccaatttataagcaattatatcggaatatcagacccgtagtattgaggtcatgagacttaaataccaacatattggtagcctttactctccacacttatcagacatattggaactcccactaatactagccatgagacttggctctacatcagagtacgtagccatttttttgcactgtatcattagtcgcaccaaatcccaaccataggatgcactatattcgtaggagattcccttactgtaagcgaaacgtatgttgtgcactccacttacaccagtgaaatatttcataggtactaaacttcgctgagatctctgagtcacagtcctactgagagtgcatctaaagcctgacacaccagcttccggactgtgcgctttcacaattgcttcacgtgggggaatgcacgttaataagaataccatgtatcgtgtgccgctcagagccctgacacgttccgagacttgaaatcctgtggaggcattctagaatgtgagacaagtaacgagagggtttccagaggcagtcgggatcaaactcagcttttgacgtcggcatgccgactgctgacgataggtcggtaactactataaatccataccggtaagggttgctgtggttacagcagtaattgtgaactcaagaaatagttacaacgcttttaggctactagatatctactcattctatgggtggaacatctcctggagtctgctgtggtgtgttgtgggtatggcctcgcatacgggttggcctctagaagcgcatagtgggtaaggatcttttgaatagcgttgtgttcatcttaccagcaacttagctagctacaagtgtctccttatatgattattgcatgtgtggtactttctataattgtttctagcacaatgtacgtagcttaatctctctgtttggtgttaggtgaatctggaccaataacactggatgaatgcctgtagcaacaataacataattcaattaagcctattgagaaagtcctattgttcaagatcctattgttcaatagttatagaataacctattttggcttagtctaggaacacatgttaggtcaatgtgctctattgttgagaacaatagcattattcactagatgatttcctatctgggaaaaatattgccctgtataaatgaaaaccctcattctgtaggcttgatactggtataatttcattcttacggcattcaatggggctaaaaggctcacaatagaacaataggattggtaacagtgccctgcctacctgaccgtcaggactatactctccaacaatttcggattattgtctatccaaaagctccaatcatctttgcatacctcagttccttcgttgtctgtcagacttcgtctattcaagcttcattatactcgatcggttaactgaaacgcctcgacttcacgatggagagtaataacgaaagcagcgagacttgggaagttcccatcatgctcagtccggagtaagatatccttctgtttcttccattcaacaatgctaactgcaatggaggaacctcagctttgaggaaatcgctagaatcaatcccttctacgacaagatcatggatatgtggaacaaatcagctcaggccgcaagtgaaatgatcatctcctcaggaggctcgtcgagtcagtcctctccgtcatctccgtcgacacattccggaaatgaacagtcttgtgttcatcgagaagcatctgcatctctgctgagagaatgccagtgctatgccgaacgtcatgtacccaagcaggcatgcaccttgctccaggttggtagagagcataagccttcttatcggactcacgacggggttcttactgaacaaactgctgtcgtcgaacattttgatcgctccagaaacgcatttctcaactcggtccatcctatcgagcattataatcataatcaggtagatacttcttgtgtggaacctgccttaatgccaaccaaaaccacgcacaagaagcttttcggtgaacatggctggctcggctgcactgccgacatgaacgatatttcgagcaacgctcatagattcaagggtttgagaggactgggcagaaaggtcatcaaacaagtggaagaacttgtaagtgctttcattttttcactccatagcatatatatgctaatgttggtttcaggcagaagatatggccagggctcatccaaaccccatcatccatgccagccttcgcccaagacttgtccccgaatcaaccattcccatctcgcttgatcctccgacccaagcaaagctgtattcagaaatggaggtcatgctgtgcgtcagcaccaacaagttccttctcggacaatacaatgagggccgtctgtccgaagagtcaattcgaaaggtcactaactattggggatcgaaaaaccgtcctcaggttgttgagttccagttcgaccaggccacccagcgccggttggtcctggcgaatatccggacacttcgtttcagtggcgaatgctcaaccaacgcagttctcctgaagtcgaacttgaataattggaaggcacttagcaaggagatgggtgtccgcaccttctgtttccctgatagcgctgtccgcaagcacatgcatgacatccataaactgttggacatgctggacgcgcctcttaccacatatctcacatttgaagagcttcagatgagcatactgtctttgatgaagtcccatctggaaaagctctgccaagttgatggtagtcatgagaagctgcgtcacccaggtcgaaagtacgatgggcatcatttgatggcgcattgagcaattcgatgtacctcattctttcattttctttatttcggttttctttccttcctgctatctgtttcatattccagctcggcacaacaagcaatagtacatgctaggagcggtgacgagtaattagcggcttagcacgcgtttatcaagagatgtatctattatctagatagaaatccattccaggacataatacatgcaaagagactgatctcagactctcatagaggaatagtgagcgtagcgaggtacttgactccacaatcgggattctgacagattgacttggcgggcgctttcctgcagacacaactcaccgtgcagcccgtggaccaatcgccacgtatgcatcaccacatcgccccgaagcctttaaagtacagaaatgaggcacgaggagacctgagaccagctaaaccgcctaaaacccctcccgggcaatatatcaccaatcatttgaacccacttacgagtgccctgactctatttgatacaacagtcgatcacacctcaccttgccagatcatccgggtaatggctcataaacttccgagaaggtccgtaaaagttcttgagaatgttcaactataacaagaaacgggtattattaagtagtcctcttggagcgatcgataacaactcgcacagctcaactatcgtgtctggctgtaaaaataaaatgagtttcaaacctcagcttgatatgtcaggcgcagtttactggaatgtagaggtttgttggcagcacctaattagctacgtgtcgagcggtcttccttgcattgctaccatgctcccagtagtctcgagagctttccgccaacgctaggagcgctccagcacccgtatggcttattcttgcggtctactccatagtagagagagataagatagtagctaaacaagatccacacggacagttagccgcgataactccgtgatttttggctccgcttggtgcgacatcctcaccggttttacttgagcaaatcgagcgacctgcagatcaagaaaaaaaattcccatagaaacaaagagggataatccttcgtggctggtgctgtctgagtaatggttgaaatactagtagactaagcagtagtggaaagagtggtttggctgccaatcgagatccgcgatcgactggcggctttcacgtgggccgacgtcatggggtcctttgcggattcacgaggaatcacttttctcctgcagccaacttttctgtcccaaatccatctccagctggctggctggctactggagcatcgcatgtcttttcggtgcatctccctcgattatgaatcatattctcgaagctggtatcgggctttttcgaagctctcgctgatacctggcctcccttgctgacctacaatccagcgcgcgctggacgtccccaacacagaacagcgtttctgcctacattttcaccgggctcggactcactgccatgccggttagcccttgatcactttacactggctttgtttatttacacagctctcttttgtggtagtcctgtgcctgctacgtgccgtcacgatgacgaccggccctatccatacctacggcccatcttgtttactcgcggaagacgatcccgatctctctgcctggctttcttcggataaaccacctagcgttcgaccgcagttcttttacacgtccaccctcgcgatcgacgatcctttggctgcccttcctcctccaactggcggtcaaggttctggaaatgagtgggctccgctccaaccattctcagtgagggataatgccgccctggaagattcttggagacaattgcagcagaccataagacaggaactcgatgggaaatacaaatctcatagtgctacttcgtcaactagaaatttgggaatcgatgtaccaggccggggatatgctggggatactgggaaattgaagcaaaagggactacatgacagaaacttggctagtggccagaagagtgctgccgatgctccttcgcgctccttggatgaccgattaccacccagctctcaaatacggtccaggatcgaagctggtaaagcaggcgcaaacaacaaagggtctcgagaaaggtcacgcacactcggcagtagcttagatggcggtcctgcagccggtgccgtgttacggcgcagactagagccaccttttaacgacaaattcggatcagtagaaactaaggctaatgaggtactaacgagtgatgatacaggacctgatggcgcagagagcaccagtccgcgaagctatccttcacgtgatgtgagcatcagtggctccccttttgccagagctccagtctcccccagacacagcccattgggtcggtcagtggagtctatttcgtcgaaagacgagaaccaagattcgttaatcgatccgcccactcaatcagcaccgaaaccatcagggctacgaacgacgattcgacagtcatctgctgatgaatttcatgatgaaactggagaagccaacccggctgaagagccgcggcacaaagtccccgtaggtgcatctcggcttcatctggtcgagttaccaagtctgaaggtaagtccattttttcttcaatgcggttggccatgatagcgagaggctaaaatcggacagatgaaaccgatttattggagccccctacatgatatctcgagcgtgtttcgtgcgacatggttttacaagaataccatgctacccgtggagaccgaacttgccaatagattggaagatggctacaattacctgaaaccgtggactgaaacatggcaagatgaactcaacagctgcgttgagaatggtgccgacgccgaattgaagattgtacacaagctctggccgaaagagaatacaactagaccacctacagctgtggctgcgccaggttctgagatccgaagctctaccgctcgtctgtcaaacgaagacaagcgcaaaatacctgagattatgcctttagatctcaatcgagctgcgggtagtacatccgcgcagtccgacactgtcaaaccgtttttgaattctagtgttatctacgccgacgcgagaaacgcacaaattctccggcccagccttcttccatctgtgtcaaggggacgcaagccgctcagtgcgatccgtaaagggagacaaattggtattcctgtgattcgtggcttcagtagacgactgtgggaccgactacacccaagcaaacccagcccagtagacgtgaggaactatctgcgcagtactcaatctcgagcgatgtcgacgacatcccttgagcccatttgctatgcatgtgcgatagagggattgcggcctgctcccacagacttggtgctagtcatacatggtattggccagaaactgtcggaacggatggagagctttcattttacccatgccatcaatgcctttcgaaggcaaataaacgtggaattaaacagcgaaccagtctggccacatgtgcgcccaggccacgggggcattatggcccttcctgtcaattggcgttctaccttgtccttagatgaagccaacctggagtctccggctggggaagaccctgctgcgaaccactattcgctagacgatatcacgccacagacgataccggctgtcagatcattgatcagcgatgtcatgctggatatcccgtactatctgtctcatcacaagcctaagatgatccgagcagtagtcaaagaagctaaccgcatctttcgcctttggtgtgagaacaatccagggttccagcagaacgggcgagtgcatctgcttgcacattccctggggagcgccatggccttggatatactcactcatcagccaacgaaaatcccttcctttaacttttctaaaaccgaagttcacggggacatttttgaatttgatacgaagaacctcttcatttgcggcagtccggccggcttcttcctccttctcaacaaaggtaaatctagactctcgtccacctttattccatacaccggattaacccagcatacagcgaacctactaccccgtcgaggacgagacaaacccggctgtgaaggcgacgaccggctccgaggcgtagcaggtgaagcagacacatacggctgtttagccgtcgacaacctatacaacatcatgcacaccactgatcgtaagcatatatcattccggactccaaaccaccacatactaacatacacaacccagcaatcgcctaccacgtcaacgccgccgtcgatagcggcctcgccagatctctccgacccgcctccatccctacctccgccgcatctttctggcaatccgtaggcagcgtattccgctggagcaaccccccagctctactcccctcaaacaccaccgtccccacccgtccagcgaccctcaacaagctccccaccaacgtcgagcttgaaacgcacgacttcacacatgaagaaattgccgaaaagcgcatgtttctccttaacgacaacggccagatcgactacttcctctctggcggcggcgggcccttgaatatccagtacctgaatatgctcagcgcacatagcagctattggaccttgactgactttgttcgcttcgttgtcattgaagttgctcgcaagcagggcagagaatataccctgcctgtgcttcgggcggcgaagaagaaggggtggaagatccataaaggctgatgggttggtcaggcccatgagacacaatagcgaaagtttgcgtgttgttcgtttatcatatctaggtctatttaatcatcgttggttatcaagtgcgactggtcctgggaatcttgtggtgcggacattgattgatctaacacttgtttttctttggtggtagcgataccctttgttttggagtccacagtgcgatgtgatacaacagcttctgaacttgtcttctggtatagaatattgtattcttgcatggttttggcaaaataaccagaattcatttaacggggaaagaaactgatttgcacatataatggtaacggttgtaaaccgagtgatatagttttgatatcatactaataaaagctcgtatccaagccatccctcttcatttctccgacaccacagcccccatcatcaacgcctcaaccaacgtccctttctcaaccttctcagtcccgggcttcaacaccaacagcgcattagcactcgccagactgcccactctagagctacgctgtcccactccctccaatccagtactcatagcataaagtcgaccatccgaacgcgacgccgtaacaatcgcccgatgatactcggtgcgtttcttatcaaccgggaagggatgcgccaccgccacagacacaaggggaaggcctagtggcggggagatcccagcgggtgtgattttccgctgttccatgcccatgagcttgtggagggagggcagcacgaagagattgagggtgacgagagcggaggcaggattaccggggagggagaagatgagtttcgtttcgcgttcttgttgtcctgaggatgacgatggtgttgaggagggcttgaatggaatcgtggcaaaggtggtaggtttgcctggtttcatggagacgcggccaaaatggatcgttccgccgagggatcgctcgatggtgggtttgaggaggtcgagttcgcccatggagacaccgccggtcgtgatgattacgtcgacgctggtttgggcttttccgatgcctcggagggcgtcgcggaggctttgctcgagtgctcccactggagtgtcgcgggcgatgccgagatcgacggtagggaaaccccaagaggcaaggcaggagaggagggaaggacggttcgagtcacgaatttggccgccttggagcttgcgagggtcattatgttcgaccagttcgtcgccagtactgaggactccgatgcagggtttcctgtagactttcaccgtctgggtacctgtcgcggcgagaaggccgatctcgccgcctaccgaggtgatgagatcgcctttccggaggatgcatgaccccagagctacatcgctgcctggttcgcggacgttctcttggggcttgatgtcgccggttaggatctcgactgttgcttcttcttggccgtctggggtcgatgaggcgagaacggtgtcttcgaccattactacggcgttggcgttcggtggaagcggtgctccggtggtgattcgggctatagtgccgggttcgagtggggataggacgcctccttcattggcgtgggttatggatgcaacggggaatattcccttggtgttgggcccggcattgggtgactcgggcgcgatgacggcgtaaccgtcaacgatactggcacggtatgcaggcacagcttccttggcgtagacatcttcagcaatgacggatccaacgagagctgttgtcactggagcttcaatgattgtcggttcgggcgtgtgttggctgatcaatttgagcgcttcgtcaacagagagcatcggatacggggactcgcggtatcgccggtttggaccggcgtttgggtcatttgactggggtcgttctgacggggaagtatgtgcgcggggaacggcatgtccatgactatgatcatggccaccgtgatggtgatggtggtgatgatgatgatgatgttggtctgccttactaccagaggaagttggcgcagaggacactcctgcctcggcttccagcttcttgaccccgcctgcgtgcagagctctggagtttgcgccggccgcctgactgcacgcatgcggcaagagcttgatgatagcttcaacgttttccttggcacctttgggagatccaggtacggtgacaatcaatgtcttgtctcgcacacctgcaacagggcgagacatcattgcaactggttaggtttgttagcagtcaagtatcacaatgttatcgctgacggccttacaaggggtgactttgagagaagctgcaatcatcccgtgtctaggcgcagtaagttagtaccggtcataaagccgacatagaagagttgaagtagacgcacaccaggccagatgcatggcgttggatgagaggcgatacggcctgtctagcattagcaatgaagcgcgaagctcaaggacaggtagaagaccaacctcaggcgtgatatcctttgtagcaaacccagtaccaccgcttacaatcacaaggttaacccagtttggtccatcagtccagtcacagatggagcgttggatatccaacacactatcggggacgatcttgataacgggctcaccccagttgttcgatccttcggctgagatgacggtcgtaagtgtgtctcccactctatccgtagagggatcttgcgaagcggtatccgagacgatcaaaatcgccgctttgagggtgttgtctgccattgtagggatgtgaggggttgctggagagtctcctaccgggaagggtggggagaacggagatgtcgataagagcggaggctgcttgactggccggagtggtgacccgcagcgcctactaggtatgctgcatatcattctagtactgcaaactgctacagtaggtttcacttcaagaagggaatacatagcctcgcctatttatcttggttttgtaaaagttcctatgatatctcctaacaattactgtacacctttcctcctcttctttccccatcaggcaaaccaacaaaagcaagactatcaatgcaattcacgcatagccaaccggtctacagtcaaatcgaatccatgcgcccaatgcggcctataaataggacaaataacagaaaagtgaagacaagaatgatataggtcgtacagatcattcccatcatggccctctacacctccaccagcaccattcttcaggcagctccaaagtcaagtgcctttcctccgaccagaagcccaacaatcaatccgaaaagaccgagaacagagctgaagatctcgataacaaggatcttgacgaacctatcgtgcatattgttagcgttcactccgttagagagaaggggctgacgaacaagctagggtcagcagcatcggccagggccgcaccacttccgttaataccgacggagataccgcaaatcaggttgcaggcgcccacagtgataccgccccagaacagcgcatatccggtgtagtagttgctgccagagaaggcctcatcgccttcgacgaggttgagcttggaggagaagacgatagccatgataacaccatagatagccacgacttcacagaaaataatcgaaatcaagttcttggtacggattctgggtgctttgacacctccaccaacgatcgaggagccggtcaagaagatacccctgatgggaacaaagtcagtatttcgttcccaatgacacaagcggaactcgtaaagccataccatgcggcaccaaccaccgataagccaatgcacatagcaatcccaaagttcgcccaggcatacggagacaccgactcgaggaagtagccgatctagatcgaattagcgggtgttcactgctcatcgtagtcgtagggatttgtggcgtacgttaatctgttcgccttcgccgcggaagaggtagtctaatcatggaaacaagccaaattagtatcttgatgaagcccactgcgccagaatgatggggtttccttacacagtccgaccaccgctgcggccacgattacaacaccggcaggatagaggagacccatgatgaaaccccggcttacggcactacctgagtgctgaaggatatcaagaaaacaagcgacgggggccccgaagaggagaggagcagaagatagggagtgagacgaggaccgtagggagctcttgaccgaagcgtgtagctggaacaagccgccagtacagcgggaggtggaggtcgggccgccgattaatccgcgggcgtgtgcttgtcagtccatcatcccagcataatacaaatacgcagtacataatactgtccaagttccccggaccgatccatgggtcgagctctcctccagtcgtcgtcttgctgaacctccctgctcccgatatatacggtcgcttttcgcacctctcgtctctcccccagatatacttccacccctatatatgtccttgtatccttagtgccctcctcccacacttgaccgctgcccaccgccttaacacttgttgactttgcgacgtgcctccgctacccctgatttcgccgccactcctactatcaagaacatctgcagtcatggcatccacctccggggtagggtcgtattcgaaccctctgaagaaattcaagtatgtcccgcctgcagcataactttcggctttccttaatgtgcggctaatcgaattgcaggctggttttcttgggcgagcagagtggtacggatatcttctgcgacgatactccaatcattggcgccacccggtctctgacatctgccttacagttggaaaaacctcattgatcacacggttcatgtacgattcattcgacaacacgtaccaagcgaccattggaatcgatttcttgtcaaaggtatactacgcctagtcgactgcttgtgccctgcattagcaggccctcaccgagccattctcacacggtctcatggttcccaatacgctcgcgctgctgcaaaaagctaattcgcatcgctcgtcttagactatgtacctggaagacagaactgtgcgccttcaactttgggacacagctggtcaagaacgtttccgatctttgattccttcctacatccgtgactccagtgtcgctgtggtggtctacgatatctccaacgccaagtctttccagaacacacgcaaatggatcgacgatgtacggggagaacgcggtaacgatgtcatcatcgtcctggtgggcaacaagaccgatctgaacgacaagcgcgaggtcacgacggcgcagggcgaggaggaggcgaagaagaacggcttgatgttcattgagaccagtgctaaagtcggccacaatgtgaagcagcttttcaggagaattgcgcaagccctaccgggcatggagggtgaagccaaccggggagacaaccagagtccgttatcctttccccgcccatggctcgaattacacgggatgagtactgacaactcttacagtgatcgatgtcaacatcactccgaaagagaccacgaccaacgacggatgcgcctgctagatattgtactctctaattcgtttcattccggccatactccctacttgcgatccctctccatctgtgcctgaatctcaatgatgaggcttgagattgtccataatgctcttcatttttaagatgtacattttttcttccttttatgttccaggtgaatagcgtgtttagatcaagcttgagcttttctttttctttcgactgcgtcttctcttgctcttcttgaaaccttaccttgaaatccgacttttgacgggagacctaggcgttcggcttgtgcattgacatcatattgcatttccccgcggtttcccgacttttgtgctgttttcttgtctgtgtcgctcgcttcgagggggcatcatggatgataatgatgatgctactgttgcgatttgttagaaataccactactccagatggcgttcatgttgcactggccgaggcatgggtggcataagcttttgttgggatcgctggtggtctaccaagtgctgcggttctcgtcgtatgatcaacggggagtgacgattaggttatcttgtcaaccgctcatcccggcgatctgactagtcttgtcggagaaaaatcaacaacatagatgtggaagacctttccagatcagcccctgagagagaattccatgcagaagggtgggttcaatagtaagcaggccatcaggcagtagcattggtcgtactcgtattatgatgtcttggcaagcacagttcaagtagcgaatgtacgtacgacatgggcagtctagtacctcctagtcggcaggggatccatccaaaacgggggggcgaaagaaaatgggtgagaaatcaaggcccccatcgaacaaatggattgttcaatctctgtatacgatactcttttgacagtagcaagatagtaatagtagtcagtataacaggggtcagtagtatgtcgctttaagttcttgtgctgttggctacagcgaacaacgtcatggggcagcgcattggcggtgaccacagggtctgttgcaagcagcaccgcaagaaaagggcatcgatcggcgggcggatcgcccggaaaatcgtgcccctgtgaaacccgcaattgggcgccagcgtcacttaaacacgcccggctgcgtcctcttctttcaatctcgctctcccgccagtccttccattccttttcctctttctgtcgctcccttccttccaccaccaacaccacccacccacccaatactcaacccccctcctctacataacattccctcagctgtgatatccctcctcggcgatatcaatcatgggtttatcccgtctcctccgcatcccgcggccagaggtatgttccaatattacaaaacccccgttgtttaattgaaaaaattaggatgggaaccagaccctgtttggacccccgttgcccggtcgcgcgctgaaatgaggctaaccatcgcatcccggctttccggtgacctcacacagactttcctctatgtcatgagtctccagacaggagcttccttgatcactctctccttactcctcaataaaatcagcggactttatggcttgctcgccctgttgaccggttaccacctctctccggtgcagctgtccatgtacatttactccctcctcgcgctcggtctcgcaactctgctcttcccgcacatccggaaacaaacgccgctacaatgtctcgcgctcgcttggctctatgtcttcgacagcctaataaatgccgcctatactgcagctttcggtgtgacctggttcctggttgtgtctcagcattacgacaacggcaacgcctcgggaccgggtggtgagaccatcgcccagaccgctggcttcaccagccccaagtatgacaccaccaaaacagagagcggtccctacgcaaggaggccggatgcgctcgggaacgctgtggcacaacctgaaagcttccaaagcatcctggtcatttgctgtctctgggtcattcgtgcttacttcgtcttcgttatgctcgcttttgctcgtcaggcactccgcctctacgtcgccgtgcctcgccacacccaactccccactcacagccgtaatacctccatcgcgagcgtcgccagtgttgcggacatcgaccgggagcccttctccccgtatagtcccgatggccaaggttggcagggaaagcttgggcgcatcatgatcagcatcggtcgcaactactggctcggcgaggatgaggaaggcggaaactggatggccacccttggccgccgtttccgggctcgtgctgaagacaacgaactccccggccccctcgagcgggagaggagacgtcgctctggaaccggacctccccagccctcccagtccgcctttcaggctgtagccttgcaacaaccgatccatgaacaggtcccgggaatgaacgtgaagatgcacggctggaccgaaagcaggtaattttgcgatcgtctttccagtgaattatcattctgaggatcctcggtctatgacccggtaatactttcatgaaactactcagggactcaagggtgcatttcggcggacaggatctgtgaccgtctgccgtacttcacaggaggacagagtgagagctctgttcttgctgagaatgtcacactctaactgtggagaggctcaaaattccgtagcctcctccctctgtgcccacccacgttgcgtggttttcctttcaatcctgttattatatatgccgaaatgatctacatacactgtttatgaatcgggacaatggaggacataggggaacaaggtggaacggtaccgcgctccttcagctttggcttgtgccgcggtgatgcgatatcgaaagcatccatcagagattggcacgcgcgcgaaaggcgccggctaccaggaggcaccaaggctggacggatgaacatatattggctttggaggaggtttgtcgtcatggccgacatggacttggcgtctgggacctgtatatttgtatcgacatagggatggttcattcgaggcgttttcttgttttcggggtacattgttgttgcatcatgctagggatttgcatatacttcctcccccattatacttgggcacccgagaacagcatcatatactttatgtgcagaacatagatacccctcgccaaatttgattcgtcagattccactggcaatgaatagtggcttggtttccataagatcggatggtgttgtgctgtatagttatctaggtaatttaatgcttgatccgagttatctccgatgctgtctcgcccgagaaaagatgatgtcaggtgcatttaatgtgattgggacagtcagtctggagcgaatcccagcaaaacccgtgagaaatcccgatgtaaggaatgcatgatactgaatacatgatactacacactcctactactagtagtacatccggagtacatagagtaatagtgctgtcttggtgtagtcgtcaatagcaccgatatattggttccactgtgaatatatatccgacaactactataacaagctgggaaaaatcagggcgaaatgaattctgtctggtacttagtagtagaggatggtaccagtgtgtatgactggagcgttatactactaattcatcgatacaagaacaatgcaatacaacgttatatgtcttttgtctggtgaatcatttttgatgttgtgttgtactagttgtactagtaagtagttcgtgctttgaaatccgccggcattcagagcaaaagccgataagtgcctgatgcacgaggcatcaatggggtgacgtgctcgagagccagtcacgaggcccccgcacttgacctgattggggatgtttgcaaggctgttcagcggctgtttgcatcgatgtcgtgatcgcaatccaatcagcgtcgggctaatccaaccccgatggcggagaagggccccaaaagtctatgaggagcagaaccattgctcgtcgctgcacggagttttgtagaaaaattagggaaagacgggctgagtgtgaagctaaaatttcccctgtctttagctggagtcattcctcttctcctctccttctttctctccttctcctaccccatcatcctcatctattgaacccgaattgagtggggagtcaccgtatgcggtgatatccatttctctctgccatcccacttcctgcgcttttcgctgcgcagccagcaattgtcaatatggcgtccgtttcgactgcgggtgaagcaggtatggtgttcctctggttcctcgctttgtgtgattggatctctatcattcaagaggaatcattcattgtccgcttcttgagtgctaaccatccttctcatgcttccagtggcgagagtcgcttacttggccagcgatgtcgttctctccgttcaaccgtctttgcaggccgattcttggttctccaagactctcaagaccctgaaggccagcaatgctcgtagcattctgccacgcggtgtcactgacgtgagtcacactgagcttcgcataacaggactgtatgaaggcaaatctaactcctgcacaggtggtggctgttcgctataacgaagatcccctcctctccgctttccaccctctgcaaacaggaaacaccgtgtctgttgtgaccacctcctccactctgctctcttccatccctcacctctaccgtttggcgaacacccctgtcgtcatccatgtcgctctggagccctatcccttcccagactactccgtgatcagctctatcaggcaatgcgggttcactttcttgcattccgagacgctccaggaggcccaggatatcgctattaccgctcatgcgttgtcccgcaagtccggcaaaggtgtcatccacttcttcgaccctgccaattccgctcgcgatgatgccattgccgaggaagataccgaggttcttcgctctgttctcaacttgggcggaagctctgtgacacatacgtctggcctgggtgcccagacgctgtacactgactccggacgggtcgctacagtgaccgaggatgtggacagtgccaccggccaggccgagggttcttccacccctgcccaggctactcagaccccttccaatgtcagtgttgacacttcgtctgttggctcttctcagagggacagcagtgtcgatagccgtgcgactagctccgctgctactaccatcgacgcctcggccactcggcccgtcagtgctacagacatttttgaatggacttctcaaatatggaatgtgttgtcggagaccaccggacgcaactaccgcgcgatcgagtatactggtccctccgatgccaagtcggccatcttcgttttcggctcaactggcgtgtttgtggacgttctgggcaaggaggaggcttccggtgagcttggaaatgttggcttgatcactgcgcggttgtaccgcccctgggttggcggccagattgtcgaatctatcccgagctcgattgagaagatcgccgtgctggagcaggtccgcaagactacgaagtggggaccggcgttcatggatcttctttccagtctgtccccggctgctggtcgggccacccccaagattgtgggatacagactgggatatgttgagccctccactgccgttcaggctcttcgtggcattgtgcagaacctgagctctccctcccctatccaaaaccttgagatcggaacctcgaaggtcccttccattgagacttctcttgagcagccccatgttgagaacgcctacctcaagattctcaaccagctcttcggtgaacgcctgcacatcgccaaccagctgggctcgaagcatgccggaatctcctctaccattgctgccagccctgaatacggattcggtgcgctgatcgccaggctggagcaccgccagcgctttattcgcgaagtcgaggaggcatccaagtccaccagcttcgccactgatgtccccaggacatggctgtccaactgggccctcagtgctgccgatgcctccaaggccaacaagctggcacccgatgtcattgcccgcctctccaacgacggttctcagcttgccagacagctcttgcagtccaagaagctgttctacgatgagtctttgtggctcattggctctgacgcctgggcttatgatctcggcaactccggtgttcaccacgttcttgcctctggagccaacgtcaacatgctcgtcattgattcgcagccttactccgagcgcaccgccgcggaccccactcgcagaaagaaggacatcggtctgtatgccatgaactttggcaacgcctatgttgcctccgtcgccgtctacggctcgtacactcaggttctccaggctatggctgaggccgagaagttcaagggtccctccgtcgtcgttgcctaccttccctacaaccaggagaacgactctgctttgaccgtgcttcaggagaccaagaaggctgttgaccttggttactggccgctgtaccgctggaaccccggcaacgatgagaacgacgaacctaagttctctctggattcggaccggatcaggcgcgaacttgaagagttccttcggagggacaaccagcttacccagctcatgaaccgtcaccccaagtactcagctgtgctttctgagtcctacggaactgaggtccgctctcttcagaagcgccaggccaaggactcttatgagaagcttcttgagggtctctttggtgctcctctgaccattctcttcgcctctgacaacggcaacgccgcgactctggcgaagcgcctcggcaaccgtggtcgtgccagaggtctgaagaccatggtcatggccatggatgactatcctcttgatgacctcgccaccgaagaaaacgtggtcttcatctccagtaccgccggtcagggtgaattcccccagaatggccgtggcttgtgggagttcgtgaagaacaccggtgatttggatctgtcttccatcaactactccgttttcggtcttggtgacagccactactggccgcgcaaggaagacagaatctactacaacaagcccgccaaggaccttgatgctcgtatcgccttccttggtggacgcaagctgaccgacattggtcttggtgatgaccaagatcccgatgccttccagaccggctactccgagtgggagcctcgtctctggcaggctctgggtgtggacaaggtcgagggtctgccggaggagcctgcgccgttgaccaacgaggatatcaagatccagtccaactacctgcgtggtacgatcgccgagggactgctggatgaaaccactggtgctatctccgccagtgaccagcagctcaccaagttccacggtacttacatgcaggatgaccgtgatgtccgtgacgagcgcaaggcccagggtcttgagcctgcttacagcttcatgatccgttgtcgactgcccggtggtgtagccactcccctccagtggcttcagatggatgctatcagtagctctcatggtaacgagaccatgaagttgactaccagacagaccttccagttccacggtgttatcaagcgcaagctccgcggcgccatgcgcgctatcaacaagtcgctcatgaccaccatcgctgcttgcggtgatgtcaaccgtaacgtcatgtgcagttccctccctgagctttcttacttccaccgcgagacgcacgccgtcgcccagaagatcagtgatcacttgcttcctgcgactactgcctaccatgagatctggttgaaggatgaggacgacaagaaggtccaggttgcgggcgacgctgttgttgaccatgagccgctttacggtcccacttaccttccccgtaaattcaagatcaccattgccattcctccccacaacgataccgatgtctacgcacatgatattggtctgattgctatcaagggcgccgatggacacttggagggtttcaacatcactgctggtggtggtatgggtgcgactcacaacaacaagaagacctatcctcagacgggacgcatgttcggttacgtccctgctgaccaggcccacattgtctgtgagaagatcatgctggttcagcgcgaccacggtgaccgtaagaaccgcaagcacgctcgtctaaagtacaccatcgatgacatgggcgtggctgcctacaaggagaaggtcgaggctcttcttcccgaaggcctgcgctttgccgagccccgtcccttcaagttcgtttcgaacgtcgatacctttggctggctgaaggacgagaagggtctcaaccacttcacgttcttcatcgagaacggacgtattgaggataccgctgacttcaagatgcgcactggtctgcgtgagcttgccaagctcgacaagggcgagttccgtcttactggtaaccagcacttgatcctgtccaacatcgaggatgcagaccttcctgccatcaaggagctgatggctcagtacaagcttgacaacacctctttcagcggtctgcgtctctcttcatctgcttgtgttgccttccccacctgtggtctggccatggctgagtccgagcgttacctgccggtcctgatctccaagctggagtctactcttgaggaggtcggcttggctagcgacagcatcgtcatgcgtatgactggttgccccaacggctgtgccagaccttggcttgccgaggttgctttcgttggtaaggcctacggtgcgtacaacatgtacctcggtggtggctaccacggccagcgtctgaacaagctttaccgctcttcgatcaaggaagatgagatcctcgagattatgaagggtctcctcaagcggtactcccaggagcgtaacactgatggcgagacccctgagagattcggagattggtgtatccgtgcgggtgtcatcaaggcgaccaccgacggacagaacttccacgaaggagtatgttgaccctttctgctatttgtcccctttgacgcaccactaacaaactgctacaggttgctgaagacgacgaggaggaggagtagacgttggagatatcccaaaaataatgcctgtggatagtcggcattcatgtgatactgttatacatcaagaagttttatgagttttacgacgatacagctgttctgtacatactgttgatgaccaaattattgtcgcatctgcattcatagctgtgattgtaaaatgtacactcccgattttctacttgataaatagccactattaggcgcacatagattcacataatcactaatccatgttagatcaaaaccatccactcattgttccaacttatagatctaccttccaaacaagaaggcggtgtaaacccatcgattctgcaagcgggcagcttatcaaacctcctccgcctccgataaagcaaagaaaaagttgcaaaaaaaccgacaccccgcaaagcacacagccattgctgcgtcgactcccatttattataccccgaattttctaattattctcccacgatccctcaacccatgaacacattcttataattaaaccccaccccaatctacccaccatggacccctccgacgaccccgtcatcgcctcctacgacatctgcctcaccgactcagaaatctcccgctacgtcctgcaatacctcgaccgacccgccggctcctcctacgacgaccgccacggccaaaaacccacctccttccgcctgaaacccaagacgggtcttgtggaagtcgacgtccccatcaacacgcgggtgaattacgatgtcagcaagggattgcgctacggtgatgcattgaagaagagtcggagtgcgcgcgaaggcggcgcgttcggtatggcgggtgggtttagttccggtggtgctggcggtggagcgccggcgaaggtgaagatggaggaagcggcggatgcgaagagcgagacggcgtcgttgatgagggtgcaaactctgggagggcggattaagagtcccgaagatggggatccggtttacatgttggcggcttttagggggggtgagtttttcccttcccttctctttgttggttggagttcgggggaaaaagggctaatgtgtgtgatgttggtgggaacagataaattgcatctttcgcctgtttcggctgttgtacagctacacccgcaacttcatcatttggatgctttggatgagatgccgactaagggcaaggggaaggcgaggaaggaaggcgaggaggatcgtcccggcgagagcgaggctagggctattgatgtaaagatcaaggccgcggaggatggagaggcggcgcaggttgcgggcaatctggatcttttgaagaagatgcaggatgagaagtggaaggattatgagtgggttgatgctgaggtgagtgttatgctgttggattccttaggctcaagggaatgtttgctaatgtgtttgtgttttgtttcgcagactgaggaatcgtggcaattgtacgaaaactacatgatgcatcaggatgtggatagtctgccgcagctgcagtcggcgattgatagtgaaagttatctggatacgatgagtgcgccgcggattgatcctgcacgaccggagatgacgggttgggctatgaaacagaaccggatgaagcagcgggaagaacagcagtctgctcaggggacaacggagcaagggtgatttagctgcattggcgggggttatacgatatgcaatatgacgaatgctgaatgacttgcacataagcttggaagcaaaaggccgtatatatagtagaaaggcagtaggctgtagtacctcacggctaagtttgcgtggtggagaatagactttaggggagtcggacaaccatatttttcaggcggagcgaaaatatagcgaagcatacagctcctgaacagctcaatgttctacgcattgcttcgatgggcctgttccatttgccatcgagatcatcgctgctggacgaaatcaatggaagaaaacacacggagagcctccagccaatgagcgcgtgtgaaaacaccagcgatcttccagaacatcacgtgccgctcacgtgccttatcgctcaatcgggcggtggaccaattttcacttccgtccgccgaagtctccgtctcgactggagatcccgtttcgcagttctcgccttcacgcctttttctcttttctctcctccccattctcccccatcctccctttcctttctctcttttgttcccttcctcggtcgttgaagggctgcaggacggcttgtcagattggatagatgtgcaccatctgacagctttttattctgggtcatttgcatccatcctgcatctatttccgattcccttctcttctatagtttttagacgccctgttttgttctgcatctaatcatctcccttctttataattgcaaataatcagcgatatacctttaattgtccagcatcgcgtctagcggtgttcgtgtatcatgttgtcccgtgttgctcttcagaaaaatgccttcgctcgtctgcgccttgcaaaggggcgctcggtgttgccttcgcctgcaacactgagacttcactctcagtcgagtcgaccttccgctctcacaaacacaattgcgaacactccccaggaacgtcctcgccggccgtctttccagtcgagtcgaagcctcgccactgccgccgaccagtccgccattgaccaagggtcgtatggatctttcgaaaccccagcgtataaccccgagcagtacttcgatcaccatttgtcctccttcttctctcctctcgcccatgaattcgatccctcgtctctggtcatcgtggatgatgccctacaaacaaaacccaaggtgttgcggagagtgaagggtcttggcggtgatgaagaagagatgctggcaaacttcgacctctccttgagactccaccgctacgaccgtgctgctattcttctttcccggcttagaggatgctacccgcctgcttctcctaagtacctggcccttcacaatcgctatctcgagggaatggtctcgcagatgatcttgacaaggcagcacaaccttgttttgcccatgcaaaagttcttcgaggttgacctgcccgcctctggtgtggttcctgacgcgacgacctatgcagttatgattcggatggccctgcgtatgttccacggcactaaacgcgatagagcagtccgcagatactgggaatttgcgaagaatgcgtctcttgaagaagaagttctggctgctcctgttctctctgaactggaagttggcgagctatcagaggtgagtttcattctactatctacatttgatcacatttactgatcacagcgtcgaatagatttgttcctccgatattcagcgcgtttcaatgggtagcttggataataacgctgttaccgaagatcccctcgcggattcatccgatttgccagaggtcaaggccgtcgaacagaagggtctcggtctgtcttccttgaaggagtcgctttcgcttttcaacggcgcttcgaaagtagccgcccccgcagaaggtgaatacgcagaggcggagtcccgagacatgtacaacctatccagacaaaaacagcttgaagccaattctatccaggccgcccttaaccgctggagacaagagactatcgaccgacagaaggccggcctcaacactactggaagcgagaagcgtttgggcagtatcatcaaccaatggcacaccgatctagtgtccagaatcgaggcggagctcaagcttgtggaacaatccgaggccaagccccctcggacgttggaggatactgagcgttgcgaatacggtgtcttcttgcgttgcgttgactcggacaagttggccgcgctcaccatccttagcgttctgtcatcttttggacggggtggtatggattcgggcctgaagctcgcttcaatcgctactggaattggctctgaacttcacgacgaattcctcgctgaactcactctcaagaaagaatccgcagcggatgccgcacggctgagagccgttaagcaaaccctctcgcttcgcaaacaaaaagacggtcgggcaaaatggcacacaattgtcagaaacctggaacaggatgaccctgccgttgcttggtcagctcgtgtgaaggctaaggttggtgctgccttgatgagtttccttttcgaagtcgccaaggctcctgtgaaaatcgacaacccggaaacgaagaagcccgagatttccatgcagcctgcattccagcatgcctaccaaatcaactggggtagacgtgctggtttcatccatttgcaccctgaaattgtcaagatagtcaccaaagagcccacttctgatctcttgggtcgccatttgcccatgttgagcaagcctaggccgtggaagggtgtatctgatggtggatatcacgtttacaagagcaacctgattcgtacgactcctggtgaaacattgcaacctgcttacgtcaaggcagccttggagaacaatgggcttgagcaaatccgccagggactggatattctcggtaacaccgggtgggttatcaacgaagacgttttcaaggtcatgctcgaggcttggaactccggagaacctgtcgccgatctcgcccccttggagcccgaattgcctcatcctcctaaaccatccccggaggagggctacgaagctgagaagaaatgggacaatgacatgcgggagattgagaatcgcagagccggtttccactcccagcgttgtttccagaacttccaaatggaggtggcccgggcgtatcggaacgagacattctatctaccccacaacttggatttccgtggacgtgcctatccccttccgccttatctcaaccagatgggtgcagacaatgcgagaggtctgctcttgttcagccaagccaagccgctcggagagagtggactgaggtggctgaaagtccagattgccaacctgtctggattcgacaaggctagtctctctgaacgtgagaagttcaccatggatcatctggacgatgtgcttgactctgccaacaacggtcttcatggcaggcgttggtggctgaaagccgatgatccgtggcaatgcttggctgcctgctgtgagttgaggaacgcgctccagcacccggatcccactcaatttgcatcacgccttcccgtccatcaggatggctcgtgtaacggattgcagcactatgctgcactgggtggtgacaagatcggtgctcagcaagtcaacctcgagccgtccgaccgcccgtcggatgtgtatactggtgtcgccgagttcgtcaaggaagcagttgctcgggaagccgcgcagggccacagcgtagccaaatacttggacggcaaaatcaccagaaaggtggtgaagcagaccgtcatgacgaacgtgtacggtgtgaccttcatgggagccatgaagcaggtccgcaagcagcttatcgatcactatcccgaactcacccaggaccagaaacaccagggagccatctacatcgcacggaaggtcttcgaggctttgggcaccatgttcaacggtgcccacgatatccagtactggctgggtgactgcgccagtcgtatcacccagtcgctggctccggaacagatcgagcaaattgccaaggaggctatgaacccggaggatgcgaagcagatggaggacccgacgaagaagttccggtctacggtgatttggaccactcctcttggcttgcctgttgtccagccctaccgggttcgcaaggcccgccgtatctacactacactccaggatctgagcattgtcgatggcagctcgggtgatgtggtctccaagcgtaagcagctgcaagccttccctcccaactttattcactccctcgatgccacccacatgatgctgtctgcgatcgcatgccaccgcgccgggcttcagttctccgccgtccacgattctttctggacacacgcctgtgacatcgattcgatgaaccagctccttcgtgaggcgttcgtgcgcatgcactcggacgacgtggtcaagcggttggccgcggagttcgaagtccggtacagcaagaatctcttcctcgccaaggtggacgccagcagtgccctgggacagaaaatcaaggccctgcggaagggatcgaaggcttcccagaaggccaccaaggtgcaggagctgctggaggagcacaagcgacagaagctcttgcaggcagaggacccagagctgcaggctcagggacgtgccatggtgaccccggccagcattttcgagcaatttggaagcgacgaggatctggcgatcgccagttctctgggagagaccgcggtcggccacgtgccggaagacctggcggctgcggagcgcaagatctccgggatggaggctgaccctacggatccggccatcgagaccctgttccagggcttcgacaatgtccttggggcgaaggaggatccccacgaggagatgcctacggaagagtcggcaccgagcaagcgcaagcaggccaaaaaatcgtatgtgcatatttggctcccgttgcggttccgtgccgtcccgaccaaaggtacttgggacgtgacgcggatccgcgacagcaagtacttcttctgttaaggcgggaccgccctggaacgcttgggcgcatttgcctaggccggggtcagttcgcgcgggccacggctgtctctgcttatggcgctttggcatggagcttgatctcggtaggaccgtgtcctgtcctgatccttctccggatgtcaacgcctcttgtacatttattgatcttctggtggtctcagtttcgggtggcaaaatcgacccgactgggatcccctccttctaatactggttctggttgttttctagcatggctatactgcatgggtttggaaatgcatgaatgaacgtgtacagtctttgtttcaagttgtgtttgatatcattgtgttggcataaaaggggactggtgtatatattcgggatggaactctttttttaaaccacattgtatatatgaagtgaaatgcattgaagtgaataaatatgtgaccttgtgagcagcgtaaaacctcccattgggcacaggccgcgtgagagtcggagataagctgacctgcaggccgtagaattaatttgccttttggggagcgaaccctgcatgggccgagagtctggaggagaattgcctgcctgcttgctttggcttgcctgctgtttgcttctcgctcttccccctcctcccatctatccgatccgccttgtcattggcgcaaggacagcatggcccatgaaaccatgcaggaaaatagtccaccgtgtctggtcaccctgagtgggattgcatgatgggccacgatggcattgacctgacgatccggagagagccccgggcttggttggtctccgtctggcttccccgcctttttcccctgcaattctgcatccccaatccttctttttctttgcctcgccaggctgtgtctttttttttttcccctccccctcctccctcgtcagcttctctttgacagcatgcgtgagggtctgctaccaactacaatccttgttctcactgtctgatggtctgacccgaccgtggtgtctgtggtgtgtgtgagagagaaaagaaagctagtcagtccagtcactctttctcgtgggttcttcaccttccccggacctgccctccgacactaaaaagccacttccccccaactggttagttgctgctagtctccttagttcatggtcggccttgtcgcttctccggctgacattctcctcttctgctgccttctaggtccctgttttttagtccctgttttagttgccccgcagactgaatcggcaatgccgtggagttgatcgttccgtggtttccttgcgaccgctcctctgcttcatcatcttttcctcctgccctcctggtcttgaatcgcctggccctcgtctaggatctgttgcgccagtgtcgccttaatctcctttcccgctagtgtagtgccctttcacgcttggggccttacggcccttccattcgccagcggtctgaatacctcacctttcccccccccaacgaccggggtcttcatgacccactggggtgattgttccgcccggtgaggatgtcaaccccctcgattcctcaattcaccagtcctttctctcctttctcttccggatcgcactcgactggcatggcgccgtctcagactgtcgggttggatacgctcgccgagggctcgcagtacgtcctggaacaattgcagctgtcgcgagacgctgcgggaagcggtgccggcgatggcgcgccctccacttccttgcgaaattccatgtcgcatacgaaggatcaaccaccctttgataatgagaagaaccagagcactggctcgggctttagggacgctctgcaaagagatccactcgtggaggctcgctctgccatccgcaaaacctcgtcttcagctccggttcgccgccgaatcagccgtgcgtgtgaccagtgtaaccaactccggacgaaatgcgacgggcagcatccgtgcgctcattgcattggtaggctttcgctctttctccgatgccggcgatgaggcggacgcttgactgacctgttctgcagaattcggactgacctgcgagtatgcgcgagaacgcaaaaagcgtggaaaagcatcgaagaaggatctggcggcggcagctgcggcggctacccaagggtcgaatggtcattccgggcaggccaacgcgtcgctgatgggcgaacgaacatctgaagacagccggccaggacaagacgtgaacggcacatacgactcggcttttgagagccaccatctgagctcgcagccatcgcatatgcagcatgcaagcactgcagggatatccggcctgcacgagtctcagacggcaccgtcgcattcgcaaccatcgctaggaacgactatcgatgcgatgcatttgaatcatttcaacacgatgaacgattccggtcgcccggcaatgtccatatccgatctgcgttcgctacccccgtccgtcttaccaccgcaaggactaagctccgggtacaacgcgagcgccttcgctttagtgaacccgcaagagccgggctcaccagctaaccagtttcgcttgggaagctcagcggaaaacccaaccgcaccgtttcttggtctctcgcctccaggacagtcgcctggatggctccctcttccctcgccatctcctgccaactttccttctttcagcttgcatccgttttccagcactttacgataccctgttttgcagccggtcctgcctcacatcgcctccattattccgcagtcgctagcgtgtgaccttttggatgtttacttcactagttcttcttcgtcccacctgtctcccttgtccccatacgtggtgggctacatcttccgcaagcagtctttcctccacccgacaaaaccccgaatatgcagccccggtctcctggcgagtatgctctgggtagccgcacaaacgagtgaagctgcgtttctgacatcgccgccctcggctcgggggcgtgtatgccagaaactgctagaactgaccattggtttgctccgaccgttggtccatggtcctgctaccggagaagcgtcgcccaactatgcggcgaatatggtcattaatggcgtcgctctgggcggctttggggtctccatggatcagttgggtgcgcaaagtagcgccaccggcgccgtggatgatgtagcaacttatgtgcatcttgcgacggtagtatccgccagcgagtacaaggcggccagcatgcgctggtggactgcggcgtggtctctagcgcgtgagctgaagctaggccgtgagctgccgcccaatgtttcccacgcacggcaagatggagagcgagatggggatggcgaggcggacaaacgacatcctccgaccctcatcacgtcactgggtcatggatcgggaagctccggcattaatgtcaccgaagaggagcgtgaggagcgtcgacgcctatggtggctcttatatgcgaccgatcggcacctggcgctgtgctacaaccggcccctcacgctgctggacaaggaatgtggcgggctgctgcagccgatgaacgatgatctgtggcaggtcggcgactttgcagcggctgcctaccgccaggtcggaccgcccgtcgagtgtacgggtcacagcatgtatggatactttctaccgctgatgacgattcttggagggatcgtcgatctgcaccacgctgagaatcatccgcgctttggcctggcgttccgcaatagcccggaatgggagcgtcaggtactggacgttacgcggcagctggacacgtatgggcgcagcttgaaggaattcgaggcccgctacaccagcaacttgactctgggggctacggataacgaacctgtcgtcgaaggtgctcacttggatcacacgagtccttcggggcgctccagcagcaccgtgggatcgcgggtgagcgagtccatcgtccacacgaggatggtcgtcgcctatgggacgcatatcatgcatgtcctgcatattttgctcgcgggaaaatgggatccggtgaatctgttggaagaccatgatctgtggatctcctcggagtcgtttgtctcggccatgagccatgcggtcggtgccgcagaagcagcggcagaaatcttggagtacgacccggatctcagcttcatgccgttcttcttcgggatttacctactacagggcagtttcttgctgttactggcggcggacaagttgcagggcgatgccagtcccagtgtcgtgcgggcatgcgagacgatcgtgcgggcgcatgaagcgtgcgtcgtgaccttgaacacggagtaccaggtaggttttcttatttcgctccctagcttggtaataatagctaacacaatgtagaggacattccgcaaggtcatgcgatcggcgctggcacaggttcgaggacgcatcccagaggactttggggagcagcagcagcgccgacgcgaagtgcttgcgctataccgctggagcggcgatggcagtgggctggcactgtagttttgcagtaacacggctgacgatgagatgcgatttatggcggtgcattgaccggtcaatggcttcttacattctgatttgatactacttttggatttgctatttcactccgggcttatgctggcttcattgtcaagaggggtggcatggcgaatggaaatatgcttacttcgtgttgatatggattcgtacatatactttggtgatatatgtggatatttgtggcatgtacactactatgcgtgatctttggacatgatactttgatacctggtcaatctaattgctttattttcatttgttgtgcaacagccgaggtatgacgccatggctgagataagctgtcgataagcattcgcattccatcctccatcgaaacaccaaaaccttcttcatataaccaatccatcaattcaacactcgtaatgacaatagtataatccccaaaatgccctccctactacactccctccgcacctcccccctcctccgctccaaaccccctcctttaaaccccatattatatctgtatacatcaaaacgccacctcggcatcccccccgcctacctcctggacgactacatcccgcgctaccaactcctctcgtccatcgacgcctccaaaaagcgctccctcgcctacgcccacctccaaaactgcaatctctgcccgcgtcgctgcggcgtcaaccgataccatgaaacgggcatgtgcatgatcggcgccgaaaccgcaaaagtgaataccatcgccccgcatcgcggcgaggaaccctgcatccaggggtttcatggctccggcagcgtgtttttctccgggtgtaatatgcggtgtgtgttttgtcagaaccatgtacgtatgcccccaacccccaaccctgggtttagataattgtagtgggttgacagttgtggacaggatatagcgcacaagaaagcaggtcatgatctcacgcccaccgagctagcggagtggtatatgaaactccagacggtggggaacgtgcataatattaacctcgtcacgccagagcacgtcgtcccgcaagtggtgctttcgattctagacgcgagggatatgggattaaagattcctatcgtctataacacatccagcttcgactccctcgactcattacatctgctggatgggttggtggatatatacctccctgactttaaagtctggaaggggagtaccgcgaagcgattactcaaagcagaggagtatgtcgaaacagcgaaggagagtatcaaggagatgcatcggcaggtaggggatttgagttttacctctgatggcattgcgaagaagggagtgttgttgagacatttggtgatgccggggttggaggatgaggggagggagattgtgagatggctggcggagaatgtgtccagggatttgtatgtgcatgttatggagcagtataggccggatgcgtatgtggggaggaggaagagagggaggagtggagaggaggaggatggggaggtcaggtataaagagattaatcgcgctgttagggaggaggaatgggggggtgttagggaggctgcggtgcaggcggggttgtggaggttttgtgaggttaatgagatgggggggtttcatctgtagataggagtgtatgatattgattatcatggtgtttatggtgcttttatccttactagattggtggagtggtgccctttcttattaggagcatgcagtaaacatataaatgtgtgttctgggcaatcctatgaaaacttgacttttttacccggtagtgttgacagccacggatgtataacagtccacactgactctttctaggaaactaaggatttggttgagattggcgggattgttcttcgtgggatcccgtgagtgattaccaggtatgatagtaaggatttaatcaccattgttgcagtcgccccgagtcaatagacccattcacggctccttggtcaattgcatctaatcaattcaatttagggggcatctcatccatcagtataggagatacctcaatgaagcataccatctaaagggaatataatatagatttagggaatgagcctgtgaagtaacccagcactatcctctcattaactccgtctctctactatctataaaagcttcggctgcaacccgtcttcctccttctcttcttcatcttcctcctcgtcatgccctacagatcttgaagagcccctaccttctatatttagatatagccttgagtttatgataggcataagctaaacgaatatatcgaaactgttgtctttcatctatcatctttcatccttcatacgcggcggcatcagcgaactttatactatttaaccaaatcatcctcatcatagcaagcaaagccagttccagaactcgagcttacagactggaatgaaaacatccgacttgggatcaagcatacagccccggagtgcaggatgcgagtatccatagccctcgaggattggaaaaggtgctgtaaatcttcttgaagaaaggtgaaattagctagatagcgggttgacaccacctactatggaatacaccaaccacagttggggatagttatcatgtcctgtccttacgtcgccgggtgggccatgtggccgactacagagatgacatagctcaatcccttcgttagattactaactacaggaggttctcaccccatttctcacttcatacctcacttcatatctcccgtgagaatgaaacccagaagctacgatcaagagcgaaagccataaaaagaaacgctatagccagcgacatattgataagagagactggcaagaaagagaccacatggcgtgcaccctatggaatatgaagaacgctaataggtatagaccccgacgggtatgctggggaacacactggacttagtggcgattttcgattggcatgcaggcatagtgtcgcagatatatcccagataagaatcaatgtttccgattccacatatcatgatcgtccttgataatcgctataatccaaggccaagtgctcctccaccgcgtgctcgacgcgcaagacatagttctagaccctctacctaatcttgaccgtgggccaagaattctgcaaagatgaggacttgacaccggaggtcagggtacgcgccaactaagctagtttgtaccctgggaggggcttaagcggaatacaagaatccgtcagtgtagactgaccgcacaggaagccaacttggacgagatcagctccatctcagacagtttcaatatcctgctatattacagagacggccgccgacaaggcgcagattttattaaagacaagctgacccgcaagcactcgatattcgcaggtggaattgagagtgcccggaccatcgtcattacatcataacttcaatagctccgaagacgaactcaaacgatgatatgctatatatctccatcctacgaccttcgctgttcctagccctaaggactccataccctaccatgaatatcgaggactccaagtatgaaaacatatcttatcttcctatgggcccgttcgtccagcaaatcgacaacaactacacaagccaatccctttcttaccaagatgccaacttggcttcatgccgcttcctggggaaactccgctcccgtctgcaaaagcccatccgaatcacatacttccccgatattgaagtactactaataaaagcccccattctggcccttgaaacagtcccgcaatcacaattaatgagaccgtgtgtcgtctgggaatatgcacatctaccctgataagcgggaattgttacgaactgcaatttcgaagcagcggtgctgttctcggagtcgagaaagcagggtgactccgcttacaaaaacgggctatcgagtccaagcgatatcaattggccccactgggcaatagagacgggaccatcagagtcgttaccgcatttgacggcttgcttggtagttattaaccagatgacagcgatcaatactgaccttttggggtttattggtgtggtggaagatacaaccaagggcatctctgtgtgagactgaatcctattcaacagtctggctttcccctatacccggagatccaagtccagacatcctatgacgagatattagtcaacagtttcatatcaaaccaggcttccatcttcctcactggtggttcatggagcgcgtctcccccgtcgccaagccgccgtcgctgctgatatcgcggggttgtctcttgtctcctcgcgcccccgtcatctacaagggcgagacggttacattcgcgaatgttttggccgccccagctactaagggtccggttctcctgagggtacacacaaggaccagtgggatgttcctgtcccgcagcaggtcgggatcgcggagtgggcttcggcataattcgtggatctgcctgcggcaggttggtttaccggcctgtccgcgagagctccggctgtgttgccaggactcccccaccctggacagggcagcagcccgattaatcagtgaaaaagattatctgttctgcagaagatacatcacttgctgaagatacctgccttcctcttcccggcctcgcgcagcaccatacaagattaggaaagataacacagagacagggctttagcaacttagtctgacctgggatcctggccgcgtatatacttacaatatgttcatggagcaggagcaggatcaaactcatattatatgtcgaatccacaactactcgtagcaaacctgacgctctagtttcatgccgttggtattggcctcgactgggcgttagacatggaacataggaccagcgagctggccatagtcactgttcctaggctgggtttgctgctgctcattggttttgtccgtctgcccaatagcaaggggatgcgcctgcagccggataataccctcaaagtgttcttcgatacggagaatctcagcccggattccgcgtggtcggcagtcgttaccgacagcatcagtttcacacccctccggagcctatactatcagcatcacccgtccgtgagacagggaagggcgcgcctggaggacacttcccgccgagttggaaccccgcgccatcccattcgaggccctggatgatccggtggtggtgtgcaatactcgccagagcaatcaagtggcagtaggcaattgtaaagccgatcgtctccgtcaaacaggatgcgcgtgttacctttgcaacaccatccaaatataagcacctcaaagttattgccatcaaggcagatggttaacttctcaccggatagatgctggatctgtccacgaaattggaatcctgagacctagcgccgagctagactggctgcattgggcaatagagtgtggattatctgagtcactccctcaattgagagaaaatgtggattggtagatcggcaactcagggggcaaggtcctagttgttttgtttagtgaaccagtatgtcctatccacccccgacactttgcttgatagccatttaccggatgccagcgacgaatactgaatcgtataagttgtgggtttgactgaagatactaaaaagggcataagtctgagacaagatcctatctgacagactcttttcattcatacctggcattccagatcctgatgctatgagcatacgtttgttaatggccctgtgccagaccaggccgtcttctttcttactagtgacccctgaggtaactggtctatagaaaaattgagtgcgtcccaaatggcgtatgtggtgcgacacacggtcccgagtatgccatcagcataccaagtgcagaaagaaaaccctgaccatcgaaaaatacatcccatagctgtggtggtgcagttacaaggcacgggctgccgatgatgagatagtagagttcatgtcgcagttcatctcgactatgctgttgatatggcgctgtcgctgccgtcgccccatgggggcccgctggttctggagttcgaacggctaatcggtcgactgcggcttggttcttcctacgaagagtgccgtctttggacctgcgaggttgatttatatacgtcagcttgttcttttaagtatcccacgagaggataccacatgtcattgcgttggaaggatttgttttcagtgatgcatcgactggatgctgagagtttgcccctgggtgatgatccataataagtaattgttgcctggttagatggtattaacttacttattactctagatatgttaaactgcattactatagggattcactattgcgatcaatgcctggagaggctgtgtatgtggattggtcatttctttggattctggaatttctggtggttcattcaataggcctggatggatccttgggcattgtccatgacatcgctgggatatgcacctatggtattcgctaggccatcttagctggtagtttagagaataatacactatgtcaccaaggaagcctgcattatctgactctcgtcactgagagtggagtagtagaaccaatgccccgacttcgctgaggataaagatgaggagcactcatgtaggtagcagaggcgacaaagggtcttgtggttgtctaggtacagtggtcagtgggtgtctcaacgaatagtttccattaaggaaccctgtgttttcaaaatgcgaatacaaagctattgatctatcatacagttagtaagaactacatcacttcatccatcaaaatcacccttttccgcatcaccaatgccctcgcctctggatccgataacgcgtaatgtagcaccgcatgctttccatctcccgccctctcgaacatcattgttcgcactctcgccttctccggtacatacccatcagcatcggctgcctccctttccatcttcgctatttcccggaccatatataagtatgacatcgaatcatgtagtccttcgcgatgaggccatgcgcggaacagtttcagcacacgctctcggatacccacattgcggcacttgattcctaccgaaaacagtgggacgaagacaccgatatcggagatgacgttggggagtggctgttgcttgtgggcgtattccgcctgaaggctggcgacgatctgctctgctagggtcacggctcgcgaccatcctgctaagtatcggtcgtagatggtttcggagagatccaaaaaggtggctatgtaggtactcatgacgatgtgactgacgcggatcgtatcaatagcccgaacctctttgggtgtaaagtattgggcctgggcgacgtatgtctcaaaggcgttgatatggcgttgcatgttactgtattgctgttgttgctccacgtagagaggacgatggtctgcagagcgatctcgaagacgaagttctgtttcgcagcgcgtccagaagcgcaccatgctatcgatcaacgggtccaacctttcctttgcttccctcagactgcgtatttctaatttatcgtactgcacgctggagagatgcgtatccgatggttgcaacctcatcacggaatcattgttaaagtgcgctgcctggactgccaattgtgcaaacatctgcatgaacaccgcgtcctcttctggcttgctaccgtcattcgtaccagcggagatggctttgaacattgcttcccttgctctcggaccagtctgattcataagaatgtacgtcccatttttcagatgcaccaacacctccctgtagttatcttgcaagaactctataaccacaaagatcacacaacacaccagcgccgtaacccgtagctggggatccccggacccggatgcaagacggcgacgaagaaccgcaatcgcccgcccgtattgctcaagtgcaaagagccgataatcgttattgccacctactacttctgttccggtaacacttccagttgtagtttcgtggaatgcccccaacgctgcaacagcgtgtccaaccgccggctccgtctgactcatctgtagcacgaggcgttgccagagttccgagtcacataccccgatcagcatgggcatcgtatatgtttgaaataaggcgagacagcggcgttcgtcggttgtcataccgggcacattagtggaaatgtgcgtgtgcagaagactagcgtgtcggaggcgcgtttttacagggagctggaataccggggatcggtcgcacgtacgacctgtcgacgtgcagttcttgcatgctggtcccggtgtctcatcgcatttgatacgtcgtgttcgacatgtgcggcaacctgttcgagaccgcggtgagtacttcctcaggcctagggttttggagcccatcgcggggttgaccacgtaacatctccaactctgacgctcggtagaatggttaagagtgaggtttcgggccgagccgatgggcagtggagcgtcccaagcgagggcaccgatagcctgaatggtagctttatcgctggaaatgaatggcgcacaaaggtctaaattagagctatccaagtcttatcagtctcgagagtattgcggaaacacatatgaaatatccttaaacagatgctacaaatccccgtggagcttatcgcgcagcacaaattactgaacccttgcaaacgacctttgaatagattgcaatcacgagccagtcagccatcagaagagcgatctaccgatcattccactcattgtcaagccttggacccgcacgaggcaggaacgctccccgccgccccccctccgcgtcgtcattggcgtcttcatcctccagcgcagcgggcgtaatatactgctggctgcgtgcctgtcttccaaactgcattgtcatccagctcggtctctgacgcatggcctggtataacgcaacctgtagttttccttagtaaatcattaacagtaacgaagcgcatacacgaaccttcatgagcaaagtcaaaacagctgctacaaaaaccatccatgaagcactctgctgctgctgtctccacgggaccagacagcttgtcccgtaattaaactgcacctcacatgcatcatctccggtggttttgtccttgaacggccacgctcggtcatggatactccggaatccacaacagcgaaattcgtcctgaatagcgcgaataggttgagcgtctttcgcgcggaagtatgactgccattcctgttccagtcgacaggttgtgatgctctctgggtacaagtaggcgagggccacggtggcaatgattgtggttatgatagattggaggtggttcatgacgggaaggagtcttcgccaagggctagacgactggcggtcatctgcaggctgggcgagtcgactggcaaggtacagagccagtgctgtaagaggagggaagatggtggcgatggctggaacccattcaggaaggggaaggtaaagtgaagctgtacgagaccaggacagcctgaagagatgattaagcttggttctcgacgccacaccgctgtatcaagtgtgagaaggtgacttacgctccaagaatgatagcaattatcgcacactattggagacgatgacttgttagttggcgttcaagaacagtggacttgctcataccgctgctgctactgtggaagccaccgtgggcaatccgtagataactgccatcgtgatttcaatgctagactatgaaggtgatgaaatatcaagcagaaggctatgtcttagtagttatactctgagtggtgagaagggaacaagctgttgggagtgtgaagtgaaggggatggagctggccaggcggggtcggcgcttgcagctacgcacatgtcaggcagaagccatggttgagcaatgcttccacagtcctgacgcctccatcgagcaagcttactgctaaagtaagtatgacaggagctcagcttcagtttaaatctagtgaacattccattcataaagagctaatgagctgatgagctaatctagggatggtggtatatttgtggggtaaatcaactcgagaatcaatccatctagcctgggctccactgtcacgaaaatgaagaccaatgtacacagcacaagggcaaaaatgaagatgccattgaagaagaattatatactcttggatttgccttttgctccatccatctgcatagagtcatgctgctctgtgtttgccgatcacaaacaccaaccgcggatggtcacctggcccatcggagctacccgcgctaaaaggtcaagctaagataacgcgaagctcttcttttccccgatctcttcctctctcaaaacttaccctgcctttccctggtgtcgctacctgttttcaccatgaaaccatacatcggtatcccagcggtgatagtgctcgttcatcgtgcttggtcgcgaaagtcgctgaccacccccggcctcattgcggctgcgctgacggccagcgcccatgctcttcatccatggtccgctccttttgtcttattaggagtattctactttgggggcaccaaagttaccaaggtatatatcctctccaacatcgtcgatccgcggtttgtaattgctaatcgcacacttgccaggttaaacacgatgtcaaagctcgtttgacgctctccgcgaccggctccgagggcggcgagggtcaacgtacccacatccaagtcctggcgaactctgttgtcgcgacagtgcttgctctcctacatacatatgttctggcagggaagcctgcgagcgcaacacagtgcttttcgaatggtcatgatgtggcggatctgttggtcgtgggaatagtcgcgtaagacttacctctattccttaccctttgttatgcgcttgctgacaggtcatcgttgtaggaactacgccgctgtcgccgctgatacatactcctccgagcttggtattctgtccaagtccaaaccccgcctgatcacctctcccacgttccgcgttgtcccccccggtaccaatggcggtgtaacgggcaccggactcctagcaggagtgctgggtgcatttacaattgccgtgtcatccgctgctattctacctttctgctccgaaggcgatactctctcgacactcaagagccgggctcagtggattctggctgtgacaatgtggggaggtttgggcagtgtgctggatagtgtcttgggtggattgctccaggccagcgtggtggacaagagaacaggaaaggtcatcgaaggagccggtggccagaaggtcagcacatgattaacatctaccggattgttaggaagaggatagtgctgatattgtcatgcaggtccttgttcatccctcttctactaagcccggcgtcccagctgataccaccggtctgaagcctgccggatcaagctcgagtgcgcaggtacacgccacagaggcagtcgctaacactgccactctgaaaggaaccagggctactggaacgtcgacggggacgtccgcaggagaaattgaatcgggacacgaaagccggagggtagagagtggacgggacctcttggataacaatgccgtgaatcttctgatggcctttgcaatgagtgttggggctatgggtgctgcaagttgggcctggggtttaaatctggctgacttggctttgtggtagccattgggtgcttgaagcgtatctatgactcgcaatgctatgacgattttcatgaccttgactgattcgaaagactagattcttgatccgtagaaaaggtaggaaggggagaaagaaagacgtgcatttgacactcgctagtcggcgggtaaggagagcgtcatgaaggaatcgctatatataatgtcaaagaccattactccaacaataccccacttcttcaccgaactggctatgtcttcgccaaaaaggcagaccagcatgcagcgggttagcgctgattatacctctcttggacgacggtttggtaccgtcgtctctccctctccagataactcaacgtgacgctctggtccctgtgatagtcaatgaaatcctcccattgttcttgtggcacaataacttcataaggctgttctgcgaaaatatctgtcggccggaatctgggtgccatgcctttggggtgcatctcgaaagtgaataacttttgcttgccaccaagtttgagtccactggaatcttcaggttgcctctcgagaagtgacttggggcgggctacgttctgccgatgcgtggattgtgggatattgtcttgcgacaacaagtgaaggctatcattccatcttcgtttcgagtctcggttgtctggcacttcactaaccgttggtatcttctgcagttgcattgcgggtctgtgagcgtcctgcaacatgcgctgtcgatcttggtcgctcaatcccggctgacacagtggcaggtaaaatgccattgttctcgcctcaggttgctttgtgatccataactggcatttgcgaaacagtcgatacgccttttcatagtttccttgagcaaacttcacccgagcctgccagtatctgcaccgtgcgatcactggtctctcaccatacttttctgccaagtcccgagctttctgggcctcgacttcggcctcgcgggtttggcccttatcgaggtagtcctttacgttgcgaagagcagtcttcatattgctcatgtcaacgaccatattacagtaggatatgatatcatctggcttgtcttcggttgccgtcttgggtttccttttttcaagcgagtacctggttggatgttgtaactggggaggtgggggtggtggtggtggtggtgggtaatcaaattgttggcactgggtgtcaggatcagtggattgagattgccatgaggcatgttctcgctcatctgtacaaccgctttcatccctgctggacaaaagatcagcctggacttgccataaatggtccccgtcatcatttgcaaattcatccgtggagctttgatcatacgaagcgccatcgttgtaatttgcttccataaggatctgcaatgcctcgtccccgctggcggccatatctgaatgctcgtactcgtcgtcgctgtctgctctgatattcaatgcggcgtctcgcatatgcgagtaattgcgcctgtttggtgacattttgcagcatattagaattggtatccaactcactgaatttcaaaacacaggattctgggtgatcctgggtttgaagcggtatttatattccataatggttctaaggagagctgcatacacactactagtttacggtatttcactactgagaagacatttgacaaatattccattatgaattgtttcaccagacttgctaatagtgttggatatatattgaaaagaagctgaggtcttcggcgatcaacggagatatccccgaagtacaccaatgctcgtatatatgatgctcttgggcagctactataactccacctgatcggattattcaagacatcttttgttatttgttgttcatccagcggaatctctccgctgatctagtctcagcaactgatcagccctaatcttatcggataagcagctacactaagtgtgcctgaaagggtcgggtccgtcactggccggactcacgcgggaatgctgagtaactttcaagactactgccgtagtgctgatgaaaacttcattgttttttctgacagtagttcagcacaggactgacacagacactggtcaatacgagctccactgaggcatattccatgcaatacggatcaatcaggtggatgtgtccaatgccaatcagacaagcctgatggatgtataggataagatggtggttgggaattgccgtgtccttgtgatgacaaactgcctcaaacaggcaacagcagcaaaccaaaccagacaaaccagggtggggtaaccaaacggaacaaacaatacccaacatggtaatccccgccccaagctaagtcatgcaaaccaatgcaatcagtgcaaacttaacgtcatgttcgtgtcggcgcttccttctggcctcggcggttggacctcttttccgcatgcgtcactggccggcggtgcttcatccattggatcgccgtgacacctggttgttccttggaaagtaacccggatggtgggttcccaagccatcccaccggaatggtgtaccctgcccagtatggtctgattgacgtgcatggccggcctcaacggtaatttccggtctgcggtgggacaaatcgccctgagcttacacatcgcggagggcgtccagacctcgatgacccagtcagtcatgatgtgctgtttgcaagggcccgctttttggatagcgcaggaacagctgccccctggtaatattgagagaggtgggacgagcagcatgatactcgtctctctgatcccccacgccaacttcgagtctgacctgtcgacctatttatccagtggtggatctacctgtagttgatcaatcttgcatttcttctctgcaaggactggcgcttctcctcatctacccctcattagcccccccgataccatccgcggtttgcgcgcgcatacaataatataagctctgtggcttacccttgaacttgtacttttttctccttggagtggcttgtataactgttgcttttctacttgctttcttgttgctagagttcggtgcttacccaatatgtcacccttatgtccggtcgtcaagggcgttgacatcgtcgatatccgtcaaaatgacgtggagttttccctggtaaatgatatccagcgaggtatagatcctccggcaggaacttgccgatccatgcccacaatgcttctttacgatgctcaggggctcaagctgttcgaggacattacgtacctggaggaatactatctcacaaatgcggagattgacgttctacggacacatgcgaagaggattgttgaacgcatcccggacaatgcgcaattactggaactaggcagtgggtgcgtcttccttccgcttggagcatgtatagagtatagggtacagacacgggattctaacatacggtagcaatctgcgcaagattgagatccttctccaggaattcgaagcagcgagcaaaaaagtggactactatgccttggatctgtcgctctcagagttggagcgcacattctcggaagtgtccctcgatcaatatcaatatgtcaagctccacggcctgcatggcacgtacgacgacgccctcacctggctagaaaaccccgcgaatcgaaaggtcccaacggtgatcatgtcaatgggctcgtcgataggaaattttgatcgtcctgcagcggcaaaattcttgtcgcaatttgccaggctcttagggccgtcggatttgatggtgctcggtttggatagttgcacggactcggataaagtgtacaaggcatacaatgattccaagggtatcacacggcagttctacgagaacgggttgttgcatgcgaacgctgtgcttggatacgaagcattcaaactcgatgaatgggatatcgtgacggagtacgataacgtcgaagggcggcaccaggcgttctacgcgccaaaccgggacgtgactataaacggggtactacttcagaaaggcgagaagctaatttttgaggaggcattcaaatatgatcccgagcagtgcgatcagctctggcatgatgcgggtttaattgaggacgctgagtttggcaatgagtctggggattaccgtatgtcatcctttggcaatgtgctactctgcatgtcatgttgcactgcattgtgtaaaaacatgttacaccagttgagaccatcatactaacataatctgtcgagcagttatccacgtgctctcttcggcttctctcaacttttcaacgagaccatcacagtatgcggctcaatctattccgagctttgaggaattccagtcactgtggacagcatgggacattgtcaccaaggccatggttcctagagaggaacttctttcgaagccaatcaaattgcgcaatgcattaatcttctacctcggtcacatacctacgtttctcggtcagtgttctgcttggctatttgtggagtgcaagtataggggtcagcatattgacaagcgcagatgttcatttgacccgagcattgggcgaaaagccaacgcaccccaagtcatatcgactcattttcgaacgcggaatcgaccccgatgtggatgaccccgaaaagtgccattctcacagcgagattccagacgaatggcctgcccttggagacatcttggactaccaagtgcgggttcgaagtagggtgaggtccatttttcagaagcataatgtggctgagaatagggtgcttggtgaagcactctggatcgggtttgagcatgaagccatgcatctggaaacgttcctttacatgcttatccagagtgaaagaacacttccgccccccgccgttccgcgccccgattttaggaagtttttccacgatgcccggcaagagtcaagaccaaacgagtggttttcgattcccgagaagacgctttcggttggattacatgatgatggacattcagttcctcgtgactcttttggctgggacaacgaaaagccccagagaaagataaccgttaaagcattcgaagctcaagcgcgaccaataacaaatggagagtacgcgaagtatctacaggcgaatcagctgccccagaagccagagtcctgggtcttgatcaagcccgagacgtacccgacttgcaatggtgtcagtcaagacggtagctacgctacgaatgaattcatggcacactttgccgttcgcactgtgtttggctccgtcccgctcgagctagcccaggactggccggttatcgcgtcgtacgatgaattggccaagtatgccaagtgggtggactgcaggataccaaccttcgaagaggcaaagagtatctacgcgcatgcagctcggctgaaggaaactagccacggcctgaacggtcacaggtaagcataccgcttccactagatgcacaggacttactgtcatagtgaaacgaacggagtcaacgggcacgaacatagcgagaccaaccccctacggcctcgcaccccggaccaccaaccggtacagcacccttcgcaagaatctctgccggtgtttgttgagctcgacaattgcaacgtcggcttcaaacactggcaccctaccccggtcatccagaacggcgaccgactcgccggtcatggagagctgggaggcgtctgggagtggacgagcacggaacttgcaccccacgaagggttcgaggccatgcaaatctaccccggatatacatgtaagcttgctgtgtgagatatatgaacacaagctaactgagaacagccgacttcttcgacggaaaacacaatatcatcctcggagggtcatgggcgacgcatccacggatcgccggccgcactaccttgtaagtccgtatgcaagactagcgggttcatgagctaatctgttcagtgtcaattggtaccagcggaactacccatacccctgggctggtgcccggctggtgcgggatgtctgaggggatgcctaagatagaataggtactcatgcaataacacataccagttcgccaccggatcgacagtagaatttcccataacttcggacccttcggaaagcaggcatacataacattaacgtaaatcatgtcccatgtagctctatacttcatcgtaggaatcccaaggcccaccgcagcggggaagctcccgataacgtgacgccatacccctcctgacgtcgttgttaaatgatccacgcctggttctccatcttcttccccaacttcttccccacgtccccccagaataaccaagacccattttcacaatgtcggtcccaaacatcaccaccatctcccccatcaccaaccgtcccatcctcaaccgcaccggcgccaacccagaagacatcgtaggcatcgccgaatccgcccaagaagcctaccgttccttctccgaatccaccaccctcaaacaacgccaggacatcgtcacccgcgccctagacaagcttgaaaagagaaaagatgacctcgccagacagatcaccgagcaaatgggccggcccatatcatacaccggtgtcgaagtcgccacggccatcaagcgcagccactacctaaaccgcatcagcgactccgtcctcggcgaagcgggcatcgtccccggagaagaagaacagggcttcaagcgctacatcaagcgcaagcctgtcggcgtcgtcctgatcattttcgcctggaattacccctaccttgttctcgttaacagcttaatccccgccattttggccgggaacgcagtcattctgaaaccgtcgccgcagacaccgaccatcgcagaggaagtcgccaatgcgtttgaagaagcgggccttccagagaacgtgattcaatatgtgcattccgggtccccaaccctactggagagtctcgttcgctcgtcctgtgtcaatcacatttgttttacgggctctgtggagggcgggctagctacgcagaaagcggcctctgatcgcatcgtcaacctcggactggaactaggcggcaaggatcctgcgtatgtgcgcgacgacgtcgatatcccctgggcggcggcggagatcgtcgacggagctatcttcaacagtgggcagagctgctgcgctatcgagcgggtctacgtgcatcagaatatctacgataagttcgtggcggaggttaagaaggtgctgagcaatttcgtggttggggacccgttcgataagaagacgcagatcgggcctgtgatatcgaagcgcgcgaaagaggagatcgaggcgcatattgctgatgccgtggagaagggggcaaaggatgagacgccggcgaatgagacgtttgagaatcctccgtctgaggggaattatgttaagcctacgctgttgacgggggtaacgcatgagatgcgggtcatgacggaagagacgtttgggccggtgattccggttatgaaggtggagggggatgatgaggccgttaagtggatgaatagtagtgagtttgggctgacagctagtgtgtggacgaaggatgttgctgccgcggaggagctggttgagcgggtggaggcggggacggtgtttatcaatcgatcggattatcctagtccggtgagtttgcgctgttgatgttgacaatgattctggagatgtgctaacggaggcataggacctggcctggacaggctggaagaattcaggacgcggagtaacgctcagtcggttcgggttcgagcaattcgtcaagctgaagagttaccatatcaaggactatcccaaatagattatgcgggctgtttcgtttgttgatttgtatttgatttgatttgaatgatgccttgatgatcgatagaccaactccagtcctgccatgacaacgataataacaactttaaatgtcaatgacaaatccacacatcgcgtaaatgtaaacataagcactagccatccttcagcagcgaagggaccagaacattgcattgtatggagtagtactgcgtcgcaatgccaccaattgagtgggtaagtgcatttggccccatcctctaaggagctagtacccactgcgaaggcatcacataccagtcagtagccagccagccaggcggtaactaagtgtctagctgactagcaacgaaaaggcaattggtaacgcccaactatgacggaccctagccaagaaagatcgctgtatgggcggaagatacgaccggaggctggctggatgttctgaggctgagataagtagatatttgtatacaatgataacaagctaatgtgatgtaatactatgtacagagtgatggtattgaggggggggtgcattctttgtatgatgtcctgcattctttcgtgatgggaatgggagtgggatgacaagggcgctttgtaagggaccacggaggagaactattcagataagacgatttatcttggtagcagggtattaaccaggtaaaccatgaaaactcaatgactacagagagatttcagatataatgaatgatctgaattggactgtattagaaagggctcctataaacctcttgcctcaggcaaacaccatccatccatacttcatcaactaacaaccactatctacttaccctacctcaccaccaacatgaagataaacacccagctagataagtctagataataaatagaccctttaacccccaatttcagccataacgaattccccaactctcctgtccctctcctctccactctcaacccctacagatatttatctccaagaatgctaaacttcgttacctatcacactatttacccgcggatcagcgggcaaatctctcaccagtcagttacagaaggccggaaactgaagagaataggcattgttgtgatgcaagggaggtgggtgtcggtcttcttaggtatcgccaccatccctcttcttcttcttctccctttcatctcggtagttacctagtacctatctatctacggagtaagtacttaggtaggggttcgaattgactttccggggggaactcagtttacttatttacttacttactactcattttctgtatccagggtctggcaatcgtaacaatgacagcaggatagtttacttcgtaactaagtagtcagtaagtgtaagcaggggatgggacgggggaggaggggacaaaagggggggccggaagtattcttagaatgttcgatgcataactaacttattacctacccattgcccccagtagtattttcccccttatgtttctggattattttctatctatttttattatttctgttgtgttctacattgtaaaactgaaagtaagaaatgtgtgctgtgcaacggagtacatacttatttcacacggagtatctattctcaaacaccgtagatataccgagtagtaatagctataaccaaaactattcccgttgttgcagtattctattctgggtaacccgataaaccggacaaaatgggggccagccagcccaagttggggccgatcggtgatccaagccaccaccaccaacaattaatcctccccccctccatatggggatgacgaatgcgaaacttaattcatcaatttcacaactgtgtaataataataattattattatagtattctatagcatatagcatggtttcatgcagtcagcaatcggtgcagcgggtggttacatacatacatactgtatggcgccctgttttgggtacctacagatgtggcatatgtagcctacttacttagttgtttacatacgtaaggctttcagtgccacctagactagactagccaagtaatgtctacacaccgtatgtatgtatgtatgtatgtctgtatgatttgcccaacaattcttcggagattatcgcgtcactcactcctctagtccgtctccttcccccagttaagaaaggggatggatggacggggagcatatttgcttctgtgacggatactaagaaagtcagtaaactgagctggacctgccagggggaatgtgtcacccgcggcgcgtaagttcaattacttactagcaatgcttccaatcagtttccggcacataacataaggctgtcactgtggatattgcatattacttcctcccccatccaagggtagcatagctagcgtaagatagttgtcgtgccacaaaattccgccgatccgtcttaagcctgcattcagatttgcacgggcgaaaaaccgtttgttcggttcgagcgaaagggaaaccaaaataaaaaagaaaagaaaagagggccgaaatcgagtttctcctgcagggtgtttcgtcgtcgtttccatatatctagacttgttttctctgaccggtcttttctttctctcttgtccttcttcttcgtcttctattcctgcttccttgtttttattcttttattgttttcttttcttgatgcgcccaatgtcccactgctagagctttttttgttctgccgactagtccttccttttggttctcactcacttactctcacgctcgctcgctcgctcgcttcttgtgtttcgtgtttcggtgttgccactcgttttttaaaactaagccctacatacttaactctttgtcactcgtttcatagtgtcacatcgtcattgtcgtcatcttcgtcattgtgattgtgattgatagaaagctgctcttcgaagcatccactcacttttgttgatcgatctgctggttgcttgaactagcactatctttgctttttgtgtttcttaattggcatcggtccctgcctttgtagatagtgaccgatctcgatctctcgttcactaccaccattctcaccttacgacactcgcttgattcatcatcatcatcataatcatcatcaccacctaaacaacaaacacctgaagtcactatggagtgttttcggcagatagctcgacttgtcaagtctccctttcggcgcgagaagcagcagaaggtgctggaaattgtgagtccaacacatcccatcatgtccccatgatgtctctcccacccatatgctaatgcagtgtgcactctagggacccccaaccgactttcgtaaagaggaattgcccgcattcttctctgatgacgagtcagtaacctcacgtccctgactattctgctatccagtctaacatcactgcagtgcggcaaccttgcacagtcggggttccaccctagagaaggagaaggaagcggcggccaccgccatggaacgtcaaccatcgacacgagacaagatcaagacgcatgtccggaggctgagcgtccgggttgcgagaccagtttctgatgcccacgatgagcaatgagccgatcaaatcgatgccagctgtacatgccggttgcatatcaacatcatcgacagtttatctcgttacggaagcatggaaattcatcgtaaattctcctctcagcgtgattcacggtctgcaacgtcaaaacaagaatgttggaacttcattgagacgcgatttctttgccttggggtccgggcctcgtggatttggtgctcttcgacctagtgacggggatgatatcgggccctgcatctgattgcttgaccgagacggctctggaagcccgtcaaagtcatcatcgaatattaatctcttcttggatttggtcgccctcggtgtactgtatctactactcatagactgcactcttctgattccattgtccccggtagagcgattattcatcgggctgcttcgcgagctagcagcagtaggcgtagtctccgtagtacgatgctgtatacgactcggtcccgtcagggtcctcgtccgtgcgtccagatcgtcgtcatccgtcgtttcacttagttgatcgccgtcccccatcgcatcctgtcgctcccttgctgccccatctgtaaccgcgctgcttcctgctgacgcccgcagtccagcagccgcccgcgtcgtcgacttgatgccctgcatcccgaccaacgaccgcgcctttcgggggctaatcagcagatcatgcagcgacgtacccgcccaagtatcatcttcctcttcctcctgatcatcttcttccgaatccacagcaggtcgtccaccttccaccatcttctgcagcccctccttctgctgagcggacaaatcctccgccgcagccttgcgtttagcttcctcgctctgcgcagtaacaccatcggtcggtcgagcgatattctgtatggtcgtggcattctgcaacttggcttctttcttccgtcgtatgtattctgcgtagtgtaggtgttgtgtgaaggtttgtgcgaccgcgtagaactcgtcttctaccatcatgtatatgtcgtcgttgtcgaagccttcgcggaggtatcttcacatgctgtcagcgtactgcgttttttcataggtgtgtgtagctatggtatgatcacgtactcttcagacggacagcgatggatgggagaggacggcggcgtaggagctatagcaaggcgtcagtggacctcagtatactcatattgcaaaaacgaaaagcaacggttagagtaaaaggtacatacaagaccgcataaaatcgcgcttcttcatccttgaacctggagtcatcgccatctcggcttttggagtcacatcgttgtcatcttcttctttctccttctctttggctctggtctcgcgcttcacggttcgacgcggtgtgtctgacggagatgtcttcggttctcgtttggttgttgttgctgcattgagtagccatggtaggttgcggggcatctttgtcgctggttaggatgatgattatggtcaattaaacattattggaatatgaagtgaggagtgtatgtatggatatggagagggaggatgtgaggagggaataatggtggtgtcttgcgaccgctgctgatacgcggcttctccccgcctccgcacggattagttatctaagttactttagttggagatccacttctcagcctcatgttgatatgcttgtctggctgtttgggttggtaataactgggtatcaaccgtttggaatatgtgtctttggaaagaggctgttttttttcggtgagatttgtatcgtgatttcttttagaagtgaatgaagtactctgcaagtaagctatacggatttctatctactactctcttcttcgatggtgtagattcgggtatctgatttcaatctattctagtagcaccatagcaaatccataattcagcctcatatgctaacgcgaaacgccaaaaatatgataaagccccatatcaagcaacttgccatgtcccgggcacaaaagagcaatccacatgaagagtaaaacagaagaaatataggttcaacaacgcctatcaaagcaagtggcggaaggagaaaaaaagagtgtgaggaagtgaggtaacgagagtatcaaccgatgacgcaaggtaaacgatccctcacccttaggcttcaccaggcctcttgctattgcagctcacaatcttcactttatccgcggagaccgtagtctggttatccagcttgaaagtaacgtccttgataaggaatgtccacacttcgtcgcagaatcggtaggtatcaagatgtccctgtggtggtaagaaaagccatgtcagcctcagttcgcctccttcatctgctccaagcgcagccttccttatcctcatatgcaagcgtaccttgaaagtcagacgagcgcgcactttgtctgccagcacctctgtgatcacgcgatcgaaagttgagaggatcttcatggcgagctggggctcgatccgtccttcgttgatcaggtcatcgagggtatcggtcagggagagtccgaggctgttgcggagggttagtggtatttcctgacatgtcgtcgcagaccctatcgtacctgctcccgcgatagagctcgtagtatgcctgggcgctcattgtgaagttggtagtgaggcgacaagggagattaagagagtggaagtggagccggatgattgcgatcagttggtcgcggggggtatctgcacgtgatccggatcatgtgatgatgaggagccattacatcaattgatgggaccagcagtgtcaagttttcgacattgttttcttgcgaaaggttccttttgagattaatgcaatgaattcattttcaatgctatcaactccattgctcctccggacagctcgtctgtcaaacgcttctcccggagcacggtatataacttcgaccgcgtacagattcgcagaaacaaaaggtcagtaagatagtaattcagataattgggtatttcgttcaaaattagaactaattgagatatagctcaagactcgtcacaccaaaaggagtccaatgatgcatcagatgaccaatcagcacagcaaaagctcaagcaagacaagaccaaaagcgtagctcaagcggatcaagagctccgagagcggctcgagcaaatgtctggcggtggtggcgcttcaggaattgagtatgaagatggcaagcccaatgccatgaagcgcagcgtacgaaacaacatgttccgctatatctgagccggagaagtgaattacgtccagagagcgtcccatcatgtcgaggtgtgtgggcagggccgaataaaacctacgatggctactctatccatatcaattgctagactgaggtacaagtcgaggcgttggcgaccgaaggccagctaggtcgttcaagtctgttggaaaattgcatgatcagatgtgagcgacttgtgaagttctccagctgtgccagggcatatcttgcccattgatggatgtcgcatacagcgctataacgaatcttctccgattgaacactgcacggcgcacaggaacgccaacttcaaagaaacatactggttcggttggatagatcccgtcgaaactgtcaatctcggctgggtcctatgtatggtagagaggtgtgaaaatgggggaccaagaatcgagaacaggccaaagtccgcttggaaatgacatgcctgcatgaaggctctatataccatgactacaagaccatagactccaataaacgctcgccaaagcaattcaaggtgccaatattttcccgagatcagtagagtgcgatgacctacctatcgttcacctgttgcccaccattcctgcaagaacaccagcaccaatgacaccaccgtccgacgcttcccgcaaaaagaccgacttaccgcttttctgcggcccagtcctcatgataagcctgtcaatatattgctggcatgtctccttgaagttggggtaatgctgaatgatgcctccagtgtacgccacgaccagctcctcagggcctgactgccagtccgcgggagtgggagtgggagataggacaggaacaaccctaccatctttcggacttgctccctccgggaccaaggatgacggagatagactgttggacacggcggacaaatccggagtgccattatactcgggcaaagagacattgacattctgcggtgaaccttcgtggctgtccactttcagctcgatctcctgcgcacaagcaagtaatcctacaaccgctgcggctatcaaaccagcagatcgtctctgaaccgtcctagcgatcttgcgaaacacgtttgccgacacagcatcccaatgccactcgctattctctggcggaggcatggagcgtgagagttcatcggcaagctcctggtccgaccgagcacgggcaacattatccgagacgtaagttgtcgtcagggcatactcctgtatgagtgtcgcgggcaatactttcttagacagtccactaacattggtaagatagtcgtataggatgagccggatgagctctccgatgtaccgaccacccgtcaagtattcgaaaggctggaatccgggtcgcgcacacgccctatcgagttccacatcccattttgttatgatgttgagctctttcaatggcgggtcagcaccagcgatcgtccattcagtgttcacgaccgtctcctctgcttgcgggtcctttgatttcacatgcttcgccttcgactcatggagcatattcaaattcattggaattgtggcattgcagccggtacccacaataatgcccatagcgactcgactattgggcagggatttgacagcataagcaagggaagcaagggtagcaactgtgtcgttggtgatagctgctattttgagctttgggagttcgaagagcttccgccgtttacttgaaggctcgaactcattatctaggcgccttgtatgtttctcatacccactcaggaggatcttgcgcaagtcaaggtctgacgtgatggcgaatcctttgcccattggcatcagagtagcctccgtaagggattcttgcctgtaattggtcagcagatgcaagccacgagttgtagcaataggttgctgcccgcgtaggttgaccccagcgggtaaagccactcacattattgggaaactaaaggtaattcccatttccaattcctctggaacatggcctttggtggattcagatgtcaggctttccgccaccacttccgcaatgcaatctccaatccaagaaaacaggtcctctgccttgtccatctttagatgctcttgtataggccatgcacgctcgagagtccgcctgacccgctgtctctgcgccctacgaattgtgtcccgcgatctttccgacgcgtctgtggaacgtgtgtctgactctgtagcctcccccagtagttcgataaatgcaacccgcagattggtcccaccaacatcaatggccaggtatcggcctgtctccaagccagaaggtaacctagtcaccggtgtcggtaagaactgctccttcgaatgaagggccaaatcccggtatacagtagaaaaccggcgcgcaagtttgtacaatatcgcttcatccaaagctataggtgacaggtattcgtcaagcatgcgctggcgctcgagatactctttttgcgaagggtccaggtcagcgctgtcctcttcgtcatcctccaccggctcttcgtgtagatgttcgtgctcatcatccctgcctgtaccaagatccattgcattgattggtgccatgatgtggaagaggctaagcccaacggcgagataggcaagcagtcggcccgtgtgacttgcagccagcaaacggaggtatttttgtacaacggagcggtaagtcggcggaaggaagtgcccaaggattggctttatctactcgcccctgcggaatgttttgaagcgaaggtaggacgggatgtgggggagatcaagaatgaggatccaggtttggacggtgataaggtgcatgcgaaccgaggatcccacgatggggaaaggataaccaggaagtgaacctgaatgggaggggtgttcacttaatgaggattcacttccgtcgaggccaggccaggagcgatgaggtgttcaggggagggaatgagggaggggaggtgttatcttgcaggtaaacctatacagtgacgagtgtgatggtcagtctcaaggttacatacaatgatgaacaactgatggtcggttctcaacattgtcgactgcagtgacgcgtgtcttgcaaataggatcatggagtcacagaaatgctaagaatggtacaacggtgacgatcctaatgcagggagacattgggtaatgcacccaaagagcagggggaccatgattatctcggaaggggagggaagaggggagggggtgggagcgcaagtaacaatgacacggacaatgacatacaaccaagaagactgtgctggtggagatcccgcagttatgctcgttccaagccccgaagttagaataaggctgagccgagggtcgtagacgataataaaatagtaggagagctaatcaaataaaaaagaaaaagaaaaatcaaattaaaaattttatcgatcaatcaaaaattcattgggaggtatgcttcataaggatgaaagggacggggatcgacggaagaatggcggaacccatcaattaagtattatgatcattacgacgaaaagtaacaactggaccagccggtggataagaggaaagcattgccgggtctccacacacgggaaagaaaagcgatgaggggagagagtgagagtgagagacagagagggagggtgagggcgagaacgggggggaaagtagagaagaggtgtgtatttggggggaggtcacaaagagggacgaggctagttactacttagttactcctaagttactgctaagttacaaaggcaagctccagagccgctgggatggagcagaatgcgaccatcgacaccagacgatgtgacgctggccggtcagtcgactaccatggattcgtcggatggctcgatcggggccccatttcggtccctcaaggtagaaccagagattcaatcgcgcatcctgcttcccccccattgattgattgattgatgatgatgatgggatttttctgcttgtttactcgtgcttgtcttcgtcgtggtcttttcctctccggggcagcggctttaccttcttctttctgttcccccaattgattgaccaacgtcaccttctcctcctcttctctctcccttcctttcttatcggtgacgccgctactttagtgcaagtcaacatggagaacaatggtgctgttccccatcttcctagattaatcattcttccttttcagggaattaattctctctcgctctcctccttccgcttgctagtctcccctcgactgctccgtgctaacagttagttacccagttctattcctattattcagctcttggttttctttcgatatttcctcatcccggtgtgtagtagggacatttagtcgacttccggggggaaaaaaaaaagacaagactgctcaaatgcagcaactagtaaacaacgcaactgtcttttacacaaatgtcagaaagcaatcaagtgtccagaggcaagaaattaattgctaagataaacgattttggagccaaacaaaccatgtggtgggaagtggggcgatacctccatctgtgatgcacagactgagcatcaacgcccgtcgagtcagaacccaggtggctctcacaacttagtctattcagggcgctgtcttccattcctcccattcgctgttaccatcgtgtgggtggataaagaagcgtaagagggaactgtgcttcggcctcttcgcttgcctggacgctgtggtattttgcacacgaagtgccgttctgcctctccggctcaaccgttgttttggaaagctaagtgcaatcaggcccccgtattccagccacaccttcatcaactgactctttactgtcaagaaaccataagatcgtctgttcacggtgtacagagtccagattcatcatcacgacctttctaaattctcatgctcctaattcccatgatgatggtgagattgctgtggaacctgagatgaagatggtacccatgaccggctgtcctgtcaacaagctccttttggaagattctcgctagcatcgtgtagcaaacctacaaacgtaagcacgaattcctggcttattaggctattgggcggatcgaaccttcgcagacggtgtctggactcagcatctgctgtaaccgtcatctagggtcaatgtcagacactagactccgaggtcggagagccgttgagtgacggcggagcagggaaaaatagcctgcggagtgcggaactcccgagatgtccagcgcgcagacgcctctgggatctgcttgataggggtagtgtagggaccagcggaccctgcaacagcagaagtttggcattagaggtcatccctaggacctctagctccgccttacgaccattcttcgcaatggaggacatgggaaatactggaaacactcaaaccctcaccttcgagtcatttctggtattgtgatcgtcgaaactacattcagaagaagctcttttgggtgcctactccgtaaagtgtgagtgctagtcaagtggagtcttccgagtactaaccctttgcaaatcggctggcataaagcctgcgcaagcgctaatgataggccacaagttgccgttcaccggttattctatgtccctatctacaatctatccaaggatattagtctgtcactagcgaacaatcacgccatgtgatagacctttcggtagcgcttggagggttgcagatatcatgcgctctcggatgtattgccctatgctgcccattacaatgcgactaatgctcgcgagcagaccgactatccgtcaagcaaacgctggccgatgctgcaagagtaccatacaaggccgtgattgtagtgagtacaaaccatcgcgacgctacagatgcaccctagtcaccaagctagccgatgccaagcattgatgcttgcatcttaacagtgccagcaagcatgattcgtacacaatccatatcatatattcctcctctttgatctgattggctgtggagcgttgaaggctgggatagaggccaaactactccgtagtgataattcaaagccggggtagcatggtccacagcagggcagattcactttcgcagatgctacgtctggtctgctaagcaggttggagcagcatgtatgggagaagcggagtagtcttcaagttagttaattagactcaaggaatgatgcaacctcgggccatgcatgattcttcgacggcagtccaatgtaggaaaagatcggagtgagtgagtactagcccacggtagacatcaccagtcagctaagaaaggatactccaaagagtcgattagagcctatcagccaacggtcgcttctgtggatgaagctctcagcctagcagggctgtttgggctgaccggggagtaagcgattctcagtgtaacgagagggcgaaatgctgggttgctctcggaaacccccgccgaatggcatcgctggatcgaatcgcgatctccccacattcacctctggtctcacttttttccatcatcatcatcctcccccttcaccaacctttatcaaccttccattactaccgtttaagtagcgggtagtagccaatatggaaaaactcccaactcaatccaaagccgacacttccggctatgtcgacctctccgagtcgtccgtggcgcgcccgatcagcacccgtcgcgaccgggtcgttactcggctggccgcatgtctggggctcatcaccatcgccttcctagctttatcatggacccctatctccatttccggctttaagctcttttcgtgccatagatggagaggacagcatgatgtttcatttccccctgacttgggcagggaggaagctccgttgatgaatggtccactgcatgaactgtccaccctggacgggagccgcctagcctcgagtaacagaattcccctggaggctcatgtcatgagtaaatgccccgacgctcgggattgtctccaacagcttgtcattcctgctatggagcagatcagcgataaagtcgacttcaagctgtctttcatcgccgcgtatgtagacttcctgtcctttcgaccttctagctcggaaaactgacactgtgcccagagtatccaacaagtcatcagagatccaatgcatgcacggtcccaccgaatgcatcggtgacatgctcatcctctgtgcagctaatctgcctttcccgcctgagtccggtgccatgtgctccaaggatgctcgtactccaacaatccggtcgcttgggttcgccaactgccttatcagctcgtatcccgacattccgaagcgcgacctggttcagggatgtgccttggagcatggtatcgactttgaggctcttaacaagtgtgccagtcgagaatatgatgaccttgacgacgatgatgatagcgacgagaagacaccgcttagtggcattgctctgttgcgccagagtgcattacatagtgacaagctcaacgtcaggaccagctgtactctgcgcctgaatgaatctacctggtgcgttcgggatggtggagtctggcgagactgcgcccaggaaggagagggcagcaaggtctcggtgcttgtggacgaggtgaagaagctgtgggacaaggtcaactaagtccctggtatgcttggtgagatactaataatgtgctatgagtgatgtgacagtgtttccgtgatgcaaaatgatgcgtgaaggcaacctatgccatatatgcagtatgacatgtccttagctgaacagtttgtatgcctactacttaatgataatcattgttcttttcgtcgcttgcccgttatttctactccttcctgttccacatcgtggtctggcacattttctatagccttttgtgatcagttgttgagtttgcacccttcaatgagcccactcaagctgtgactctgcagcactgtgcactgcctatgtgtcagttcaaacacgaatctgccgtacgaggctgacccgcgctacgattcactatctgtaaacatttctcagtgtttatgttgtgcggaacagatccgatatctctcattcttacttccccctgaccctctgaaatcctcagtacaccttttctctttttatcagcgagtgtgcatccccataaacgttcattgtcatcgagaactatccttttaccgttctctatccaagcagtcctgctctgatccattaccgatacataaaatcgctaaaagcagcaaccatggccagtcgcgatggccacatgcccgagccattccagcgcaaagtagacgagctagtaaggaagtatgaccgcatcattgagcccaatgctgttttgcatgccatccttcaggacccagagagtctgaactctctcgtcaacgcaattcaacgccaggcatcgctcgtgagacaccggtctcagaatcccgaagacggagagattaccgtctttgacaacgctctgatgattttgtccggtaatggccatgatacccaagacatcggagctctcgaactatacctggccgaatatcttgggatctgtaccttttctcccatcacccatgctaaacaaggtttgcatgagtatgacatgctccaaaacaccgtgaccggaggtgacctttgcccttctacctttcatttagcattccttctatggacaattctcactagcttcgcagaaagtgtatccaacagcaccaatgacagaactacagctgcagaacagcaaccccactcaagtcccgaacaagcggtcaatacttatgtccaaggacacgagcatcctcggagacagcagcacatacttcctccacggccacctccgacccttgaggaaatccgtcgccgcgagcaagtggaacgactgcttcggatctatgaaaaggccaaggcggaatacaacaagaagaatcccgaagaaattgatgtcggcttggccagatacttccgcgatacagctgagactacgcttgactttctgcgagttaatgacatgtcagaccatcccctgattcccgatatcgaattctcgtttgaacgcgccaagtgcaaagctgctcagttggcgggccggggtcgtcacttcgaccagcctcaggcagcagcgtcaacacccaaccatccttctaagaacaggagaagacgccgtccccgatatcgcgaggttgactcctatcgtcctggtcataagtgatggcagtgtggaaaggctgctgttgctcgatcattgagggttggtttagttgctggcgttttgaagcgtttctaacctcggtgcattggatgggcgttatcctgtttacaatatgtattctggggaatgaattgaattgcagcatggcaaagcgggaaattctaagggacggagagacgggtggaatgttgctgtatgatagttaaccggctagtactttgtagttaatgaaatggacatgaaggcttggcgcaaatcgctgctttagcggccaccacgtgcccccgaactgcttctcgatgttgacttgctccatcgcgtgtacgtaaacctccgagtagaacaattccatcgcttttaagtcaaagcagtcaatcccgaccagcatttccggtagtggtcgggtcgttaggctttcaggaggcatgattttctaaaccaccctaacccctcgcaatccaccaaagatggcctccttgcgccccgggccgaccgaggccatctccgtctccagtggatcatcgtctacccctcagtatacgcctgtctctgatcgctccgagaatgatggttctcccaatccaaatcgaccaacggctgggtccctgagagttcagacagccttcagctcagacggggagtcgtttactgacgacgggttcgatgaaggatatgaatcctacgaagatgtgcagcccctttcgagtagtagaactagcatgccaaagtacacaaaagaggaagagaagggggtcatcaagcaattcgatcgcaaattggtcccttttctagctctcctctatctgctttcgtttctagatcgctcaagtacgtggtttgtccactatcgcagccaagaccttctataaaaccacacgttacccatcataagattgatatcagctaacactaagccagacattggaaatgccaaaatcgccggtctcgcagacgacctgcatctctcgtcatcgcaatatgaatggctcctcacggccttctacatcacctacatcctcttcgaatggatgacgctcatgtacaaagtcgtcccaccgcacatctacatcgctctctgcgtctgcggctggggcctcgtcgcatctttacaatcgctcgctacttcattcggagccctcgtcttccttcgagcagctctcggcatcaccgaagcagcattcggccctggcgtgcccttctatctttcactcttctacaagcgcgaagagctcgccttccgaaacggcctcttcatctccgctgctcccctcgcctcatccttcgccagcagcctagcctggctcattgtccgcgtgagcgacaacggcccaatcgctccctggcgtaccctcttcctagtcgaagggttccccagcatcatcgtcgccgtcttcgcctgggtagtcatccccgatacaccaggcagcgcctcattcctgaacccccggcagcgggcaatcgcacagctccgcatggacgagctcaaaccaaaccacagaccacatcagcagcaatcgcagcaacgcaaatccttcaactggaaagaagtcaagaagaccctcgccgatcccaaatcctacatcacagccgtgagctaccctccatctcttcccccctctcctctgccccaactaatatccaacaacacagttcatgttcttcagctgcaacgtcgccttcagctccatgcctgtcttccttcccactataatccaagagtgaatacttaccccttcccccaaatactcccccaaaaaactaacaaaaccaaaacagcatgggctacagctccctaacatcccaagccctctccgccccaccgtacctcctctccttcctaaccgtcctcttaacatcccacctctcggaccgcacacgcacgcgcagcccctacctcatcttccacgcgctcttgtccgcaaccgcctacgccgcaatcgccctggcggggcatttccactcctccctcccatctcccatccacgtcgcaattcgctacctggccgtctaccccgccacatcggggttcttctccgccatcacgctaatcatcacctggaccatggacaaccggcccgcgaacgaggggaagggcgccagcgtggccctgctgaatgtcattgggcagtgcgggccgctgctcggcacgaggctgtatccggcgagtcaggggccgtggtatgtctcccgggatggcggtctgcgcggggtttatggtacttgtggcggcgttggcggggttgttgagatggttgctggggagggagatgaggggaagggagatggggaagggggatgatggggatgaggatgggattgagttggaggaggggggtggggaggagagggaggtgcttatggggtatattggtgagaggggtggtggtggtgatagtggggggagggagaagtttacgtatattttgtagagggttggattgtacgtagtagagttcttgagatttggtgatttggtatttatcttaagttgatgagattattggtgggttggatagtgacagggtatggagggaatctaataactggttaggttagatagaaggataccggcatgctcggactatgatagaatcatcaatttatcaacaattcggtaggttatagtgctctcagtggtggctgaagtccatcgtattctttcgaaatccttcgacccaaactgctatcagatcatcccattaaaccaaatcagttatttgacgcgcttgtaacccctcgtaaccaaagaatgcaacaagaaaaagctgatgaggccatgaagataagaaaccgtatgtatgatacattaaaaagaagccacgggtatgtctcccctttccccaaaaaaaaaagaatcatccataataggcgacttttgaaatgctcatcccttccacaaggctatttatagaactcctccccggaccctctctaaataccatttcccaacgtgttatgtattcattgccaactccggtagtagcattttttttttggtgatcattgacagagtgaagtgtgtgtttaccatgcagtgtggccaccgtcgatgagcatggtgctaccggtcatgaagctgctcgcatcactcagagcgaagagagcagcaccccggaattcctccgggtaggcaagacgtccgagcatattctcggcttcccagacagctcgggacgcagggttttgctggaacacctgttccaccattggggtgatgatatggccggggcacaggctgttcacacggataccgtgacggccccattccatggcaagggatcgggacagctggatcacagctgccttggaggcgttgtagacgggagaagtcatgcccttgttggcaatcagaccgctcatgctagcaacgagaaggatagaacccttctgttggtagttgaacatctgccgcgcagcagcagtggccgagttgaagactccattgaaattgatttgcataacttcgttaagagccacctgcgagtgttccagggcgctctgcaggtggttgattcctgcggcggcaatcatgccatctagtcgccggttcttgcctgcgatttccgcgaagcagtcgttcacttcagactcatcccggacatcaatacggtggtactccaggctgccaccgtagttcttctcggcatgctcttgagcggcgatgaagtcggggtgaggagactcaagtcgatccaagcagtagactgtatacgaaaatttaggttaggaatcggttcaacgcaagaatttggcttcggagatacttggaatcttacctttcgcaccagcctccatcaaagcttcagccatcgccaatccgagtcctcgtccaccaccagtgatggcgaagacacggtcgtcgaggtcaaactcgcggaaccggtgtccctgcttgggctcgcctttcaacgacggtatccgggtttgaatgtggtgtgagccatgtgagcctgaccctgtggagtgcagccgctgcgacatgggctgaatcatggcagatggtgcccaagaccgggctggggccatggccgagagcgaccggcacaatacagaacgcatggcaatggtgcgtgcaagattaggtagattaaagattaaggtataaaggacgaaaacggaatggaatcaactgtgcacgcaaagcaaagggtctttggctaccacaggggcgcgatggctatagagaatatcgtcgactaccattgttctggtagggaagctggggtttatagacctggagaagaccaacggacaacgacccgtcgaaaccgcatatctcccaactgtcgcacaagacatccgaaaatagaaggattcgaaaaatatgatggccgcgtgattgccttgatgggtccatcgtcagattctagagctgctttcacgatgacttcaagacccagaccacacccccgcccaagaccatccgtggtaccagggctggtccatgcataagctatggccaggaaagcttgccacagggcgacgcagggcggaaaggcaggcatcggacgcataacagagcaataggggggaatggtagtgtctgaagcaggtatcgtgacttctctcattgcttggttgctgcacccggcaagtcaccctgatcatttgatcgagggatgacgatcaatcattcattaaagtggaatggcccaccagaacgggattcccgtgtacggggagaccgagctgctggatcagattggaaccaacgccgccgcaatagcggtcaggacagctccatcagcgactcatgcgaataactcctatattggccactcagtgaatcagagaattgtttctacggaaaatgattcctcggatgtctgagccgttctaaacagagaaggatggtaatggtggtgcaagaggtagcgtgcgaaagcagggtagagctctccccggcttcctgctccgaaggcttccatggaatggaaccctccaataacggtctcggcatcgaagtggtggtgtaattaatctgccctcgcagcatggaaccgtctccacggcatccgcgccccatcctgcaggaagataagagtacagtactttttagtgagatccgggagttgaagggctgccctttccgggtatccttgctgcatcggacccgattttcatggggtcattcatccttctagattttctccccagtgcggcggtgatcttccccacgctttgggcgggtttgagaataagcaagtatggcacatgagaggttcatcattcataatcccaaatgtcggtggcctcaaaattcgccgataggttatgccggcttcccccctttctctgctggcggctctcgagttgccggttgtccccccagaactctcatactccgcaccccgtacatgacccagggagggcgtaaggatggtacttttgccactatcgcacgaagcttccgaataatgacaacccgggactgtaccatggatgactccgacggcatatcattgtccaacgatcggagcattccaggatgcagattcctcgagatctgccaagatgccctgcctcccccatattcgaaccctttctgtctctttttgttttcacctcttgcccccttacacaattagcattcgatccaatcttttgcgagacaaaagtccagtggcagtcgtatgtgcaggacaggggtaagagccaagaccaggactcgggggacgggaatggcgcgagaatcccaacgtagaccaaaggagagaaaagtaaacaatcctcctcttccgtaccggccagagtgactttcctatttgggtaatccgtgataggaccgaacactgatcatgtgcatcgtcagacttttcacgtttgtttatcaataaactgggcggagaacagctgtcgcgatcctgcaggcagtctagactgcaccgaccgtcgagatgggcgaccttcgtttcatctttgcacaactggccctgagcctggacaagattgagacctccggcatctccattcgatgctaattatgcatgtaagcatgaactagcatgtcagctgggattagtgcttgattctctctattcaatgagaccagggagtccgcccatccggaagcatatcttcgagtctattgattgattggaagccccgtgaagtagattgtagcatcctgtcaatgcggcaagatcggttaatgttaattgataatttggaaatccctccaatttagatgaatctcaaagcccaaccacacttggacgatgagcataactgcagggaattgggtgtctttgggcgcctttgcttgggaggaagaggacgcgtggaactaagtacgtatgtttacgcactggcggcaataggcaagcagatctcgcccgaggtcacgttcctcctggcagagcacatgggcctagaacagaacacattacagacagaagcctatccatagccactttcttacaccgtaaagccatgctattcataaatcataacgtgacatgacagtcataatctgtcttcgctgctcattagccagccacggctcgaccacctatatgcaatgtgccagcaatgaacagccttctaattatgccatttcaccgaaagtacctgcagcagtgactccaagtcccatgcctccattagcattgccgaattccagcttcatgagcagacggtcaacaccagccgctttccgaggcacatagtggaaagagccgggctcggtcgcagagccattggcttgaagcgacccgttttcacgagagtccctcacaaaatcaagcatctgccgcccctctccagatcggctgtcatcaatgtctcgcaggcgtgccacagcatccttgattcctgcttcgacactagcccgcgcaacaccgagtgattgccatacccccctctcttcccctgcatagtctactaaagcatcgacaacgccctcatcggtctcaaggtccatgttgcgctgtatgctttccagtcgaactactagcgcaataaagtgttccacactcgtcagtaaggatcggagggctttggtaaagggtatgtccgtgaggaaaagcgattcaacaagagaaaagagatagcgacgatgcgccgcggtcaatgtttcagggtcatgccgttggaccgtctgactatcacctccggaaccagaatcggccgggtcgtcaatgccctgaaaattatcggtgcgcttactattagcggaggaagcggttccaggccgtgagcccgttgttggagatccaccttcgatccattctcgaaaatgttgccagttgccattgagaacttctccctggaagtagcttcctatttctgacagtacaaagagggaggcactgctcgttgcccagattggcctcatctgccgagtcctgatgttgtctctttgtctgccgaggttgagtctactctggccgtaaggggtgctgctgcgaggcggaccccatggagacggatggatctttcgaaggaatgtatgcttccacaagtcgcccaaatgcatctgggcgcgtcggataccgagaatgtaagagtgaatcttcgagtagaccgatatatcagaggcggaaagaaacaaatcgaggggcgagcggacgtggaccgaaagacatgttggagtggggaaaagaaggtcgtcgaaagcgacgtccgaaattctggcattcatatctgatccagcaatgtcgggagacagcgcggggttgttatccacatcctgcttgatcgacagccgaagcagctcctttgctaaatcgagttcatcgtctgcgggatcgtcttctgtttgcagagagtagagctctgagagcgtttgtgacagagcagtcactacatctccttccttaatagaaaggccctttagatcttctaaagttttatacctggaggctgaatgcccgtgtttccgatacctctcttgaatgcgggtatcagcatgagataccaatgccgtcgcaaattcgccccgtcggagtaacagaaaatcatggagaaccgagaggacttcgaggaccttgggtaatgggaaaatcttggagagcgtgctttgcgacagagagagccggatggcattcacagcacttgacagtctcgacgctgatataggtgatttcaatgcagcaagctgttctatatgctccgtgtgtagtgtgaccgaagtagtcgataacccagcagaggggttcgcagcaggtgcattgcgctttgctctaatgagattcaacgtcttcccgatgaataagatagatgaggccgtatgagctgttacaaactgaggcaggagctctgaatgcacgatgaactgcgtggcagtgggcggccgatcatggcttgcattttcgcgttgtatgaagaagtcggacccaccgaggatggggagatttccgtacagcagccagggggacaattgcctcatccaagcagtctctgcaataccaaccaaatgcaaagctatgtctttcaggtcaacgtaccctgtttgcgtttccgcccgaaggtgatcgatcagagccacgccagtgcaaagctggtctttattccgcgagtatatgggccatattaaccttacggtctcccacagccattccaatcgtcgcgtccatggagaaaattcgccaacaatcgtcgacaatggcacaattccgtaaccgcccacgtatccactatcctcaaccagaatcgatttctccacttctaagattttcctctggaattcacccaggtgacgtgaactgatcgccgtcgagactgcacgacagataacagaagggtgggacgaagaaattaaggcagtatgtgttcgtaggtcggtatggaggcggctcagatgggcaagagaggcgaggagggctttctccggaggggaaaccaagggaaaggcatcttcagagatagcacctccttcagtctctggattgaaaagaggcgatggctgacccgagagggagaggaggatctcgtggagcattgtgcgcggatctctctggagacgataaagtcagatatctagacaggcccaaaagcacgagggtaaagcacaaacctcaaggaatgatccttatcttttctggttttatgacgctgccagtatagaagtccacatccaagaagttcgtatcgacacatgtgaagaagttaccctagaacaagccactctaaaaggaaaggcacgggtcaccgcgttgttcaacgcagtaaagccgcggcgcgtcgcgcaagagatgcggcgtagaaagaatggctcaggattgaatctagatgactgtcagacatcaatgttagcactattgaggccaggctttatccgggccaatctcatctggatccgagcgcctccagggaagatgcctcatcaccgccgcttctactgctctggagctcattgtcactgacttaatgggagttgccgactcgctgctgggcgtgtccgcggggctccagccaatgagtggcggcaaacctgctgagtcagccatcaacagcttgtccctctcttacgtcgccgctgagagagctcgcagcattagtgatccatccttcttccttcttccccgcctctctcacgctttctatattatatactgcgatacctgcgccttgtctttcattctacttcaaaagtcttgctcttgcactagagtatattgtccgtctgtactttgctatcgctttcgtgccatctcgcctcgcccgcttccgcgtacctcaccgctcctacccctcctacctgaccatacatcaggagtatactgcctgaaagtcttgctccaagtggcaagactttcatcttaagttttcacaattcccaccgaaattcccgttcgcgacgctgcgaagctgggaaagcgaagagcgtctgccgacaacaaagctccgccggagaagaagatcatgactgtatgccttatcacccgggtgatgccaaaacaactttgtcagttactgatcagtcttaggacgcaaagatgcaagtggataacccacaggagactgtggaggcgatcaagcaaggagaaattgatgagtcgttgtacagccggcaactgtaagtgttttatctccatgtcctttcgccactattagacagacactgatgggttgtgatgtgtataggtacgtcctcggtcatgaagctatgaagcgtatgggatcttcaaacgtgcttgttgtcggattgaagggtctgggtgttgaaatcggtgggtacaacatcttgcatataatctgaacaaattattgattactaccagccaagaacatcgcccttgccggtgtgaagtccctcacattgtacgatcctgcccctgtcgccatctcggacctgtcctcccagttcttcctccagccccaagacgtcggcaagccgcgtgccgaggtcacagctcccagagtcgcagagctcaactcctacgtccccgtcacagtccatgagggcagcaatatcgcagagaacctcgaagagttgaagcgttatcaggctgttgtcctcaccttgactcctttgaaggatcagctcgcgattgccgacttctgccacaagaatggcatttaccttactatcacggataccttcggtctctttggttatctcttcaatgacttcggtaagaacttcactgtcggtgatgcgacaggtgaggagcccgtcagtggaattgtggcggctatcgacgagaatggcttggtctcggctcttgacgagacccgtcacggcctggaggacggtgattttgtgactttctccgagatcaagggcatggagggtctcaacggttgtgctcctcgcaaagttactgtgaaggggccttacaccttctccattggtgatgtctctgatctgggaacataccagagtggcggtatctactctcaagtcaagatgcctaagttcatggatttcgctccccttagcgaacagatcaagaaacccgagtttatcatttcggactttgcgaaatttgaccggccacaacaattgcatattggtgtccaggcactccacaagttcgcagagagccacaatggcgatcttcctcgccctcataatgatagcgatgcccaagacgtgttcaagattgccaatgaactggcttcgagcctcgaagagaaggtggagctggatgagaagctcatcaaggagctgagttaccaagcccgcggcgacctgaaccccctggcagctttgttcggaggcattgcggcgcaagaagtcttgaaggcggtctctggaaagttcaaccctgttaatcagtggctctactttgactctttggagtctcttcccacctccatcacccgctctgaggaggcttgtaagcctctcggcacccggtacgatggtcaaattgcagttttcggcaaggagttccaggacaagattgccaacgtcaggcagttcctcgtaggagcaggtgccattgggtgtgagacgctgaagaactgggccatgatgggtcttggaactggtcctaaggggaagatcattgtgaccgatatggatcagatcgagaagagtaacctcaacagacaattcctgttccgcagccgggacgttggcaagctcaagagcgaatgcgcttccgctgctgtgcaggccatgaaccctgaactgaacggtaagattgtcacgctccgggaccgtgtcggacccgacaccgagcacgtcttcaacgaggaattctgggaagacttggacggtgttacgaatgccctggacaacgtggatgcaagaacctatgtcgaccgtcgttgcgtcttcttcaggaagcccctgttggagagtggaactctcggtacaaagggcaacactcaggttgtcctgcctcgcatcactgagtcctactctagctcccaagacccgccggagaagacattccctatgtgcactctgaagagtttccccaaccggatcgagcatactatcgcttgggccagggacctcttccagacctactttgtcggccctcccgaggctgtcaacatgtatctgtcccagccaaactatatccagcagacactcaagcaggccggtaatgagaagcagacgctggagcaccttcgtgacttcctggtcaccgataagcccttgaccttcgatgactgcatcgtttgggcccgtaaccaattcgaggcgcagtacaacaacgctatccagcagcttctctacaacttcccgcgtgactccaagacatcctctggacagcttttctggtctggacccaagcgtgcgcccactccgctgaagtttgacagcgcaaaccccactcatctttctttcatcgttgctggtgccaatctccacgctttcaactacggcatcaagaaccctggcgccgacaaggcctactacaggaaggttgtcgacaacatgatcgttccagaattcacccccaagtcgggcatcaagatccaagctaatgagaacgatcctgacccggacgctccggccgctggctcgtcctttgacgacaaccaggagattcagcgccttgtggactcccttccatcccccaaggatctggctggcttccgcttgaaccctgttgaatttgagaaggatgacgacacgaaccaccacatcgacttcatcaccgctgccagcaacctgcgtgccgacaactacgatatcccccaggctgatcgccacaagaccaagttcattgctggcaagatcattcctgccattgctaccacgacggcattggtgactgggttggtcgcgctggagctgttcaagatcattgacggcaaagacgacattgagcagtacaagaatggattcgtgaaccttgcgcttccattcctgggcttcagtgagcctattgccagtcccaagggcaagtacatgggtaaggagggcgaggttacgatcgaccagatctgggatcgcttcgaggtggatgatattcctctgcaggatttcctcaagcacttctccgacatgggattagagatcagcatggttagctctggcgttagtctcctgtacgccagcttctatggaccatcaaaggttaaggaccgtcttcctatgaagtatgtacccccgataaccacggagagcattacagtactaatcgcttatgatataggatgagcaagttggtggagcacatcagcaagaagccagttccggagcaccaaaagaacgtcatcttcgaggtgacggcggaggatcagacggaggaggatgtcgagattccgtatgtgatggtgaagctgaggaagtagaggggctgatcggcacgagcgcaagcaaaggcccatgatctctctggatatgtccgtttacgcactagacaccatagtataagtagcttttctatcttctcaattaaattcttctaggaatatactactgtctatgttccgcgtttttcgatgatcttgactaaatagcagactaatcagtctaagtggttccgcgaaagatgaggaattgattaattagttaactaatgaatgagcaagctgtttgtcagcgggaggcttaactccccgttattaacgcctccgtaagcaatgctgtaagcaaaccatcacgtcattggctccccgcaccccatccgtcagcgtctggcctcgtatcgcctcgtcctactttttgtatatgaacgagctccctgcccctccttgccattgctcattgttcccaatgtttcctgctcttcatcgacttcgacaagtctcgcaacatatcttgcaacccaaatctatcaccagctttccacgtccagccgcctgcagaagctccttcctccccgcacagcctatctttactccagcacgcaccatggctgtaagtcactactatcactagctgatccactcaataccaatcccataaaactaacaatctacgcttatacagacaggcaacagtggcaagatcacagactgggtcaatcccaatgacaagtccggcgagttcaagcgccagacatcagttttccgcaactggatctccagagagcctggcgctcaattccctccagagaagggccgttatcacctctacgtctcttacgcctgtccttggggtgcgtttctttcctttttatcccgatctacctttacacatactaatgctacaattcttcgcacagcccaccggactctgatcacgcgcaagctcaagggtcttgaggatatcatctcctacacctccgtccactggcatctaggagaaaagggtttgttctctcacacaccgaataacccgaggaaatagctcacacaaccaaaaaacaggctggcgcttcgcgaccgcagaagaacaacaacccgagcagaacgtcaccaccgaccctctacacgagtacactcacctgcgcgaaatctacttctccaatgaccccgactacaccggccgcttcaccgttccagtcctgttcgacaagaaaaccaaccgcatcgtaagcaacgaggtaagcacatcatccttccccactaagcaaagtacaaagcgttaatcttccgacgaaactagagcgccgaaatcatccgcatgctttactacgaattcgacgacctcctcccggaaccctacaaatccgtcgacttattcccctcctccctccgcaccgagatcgactcctccaacgaatggatctacaacgacgtcaacaacggcgtctacaagtccggcttcgccaccacacaagaagcatatgaaaaggccgtcacgacgctattctcctcgctcgacaagatcgaggttcatctggcggactcgaagaacgcgccgtacttcttcggctcggaaatcacggaggcggacattcgtctgttcacgaccatcattcgctttgatcctgtctatgtgcagcacttcaagtgcaatattcgcgatattcggtccgggtatcctgctatccatcgctggatgaggaagttgtattgggatgtgccggcttttaaggagacgacgaactttgagcatatcaagttccattatacgaagagtcataagcagattaatcagtttgcgattacgccagttgggccgctgccggatgtcttgcccaaggatgaggaggtcagggcagttaagggggcttaggggttctttggtgcagtttagaatatgttaatgttactacaaggttctgtataatttgcaaatatgcaaagttgtatttcagctaaatgtgcaagctatgtatctctctatattcatgtatcgacgcaacatgtgcggtgtggggtatgaccctacgtacaattaggaaaaaggttaacggaaaagaatcctccccagcgacacccccataaaattcaatgtacagaagacagaagcaatgtgaaactccatagcaatgctttgtcgcgcgacgccctgccatgctagtcaagccggtcatgcgactctcccaatccgtggggaagctggctatccaagtgaaatagctttccgatttcacgataccagcaatgggtgagatgaacgaaatagtcaaagccatcgggctgttcagcgagaaaggtgcagcaataaaaaagagggacggtaatctcttgacggggagtggtgtgtggacaaaggacagatccacattatcgccctaaagagatgtcgatgtgcccgtgggggctttatgggtatctcaaacgcaatgtctaaaaacggtggtaagtagaaggaaatgcgagaatatggcgaaacaattggtaaagttccaagccacggtgtcaacacagccatatttgtctctgagcagtaagcaaaccccagaaactggctctaatgagccgtctatttcaacccaagcattcgcttcgagttttcataaacgacatagctgatggacactgcaggtgcgaccttaagaagattcggcgtcagccctttgtaaaagccacgcagcccttcggtctgtattgtcttgcgagcgacatctccaatcccgttgtaggtcgcgggatgcagaacggtgccttgggcttgcattctcgtcctgagaacgttcagtggatagacaaccgaggcgccaaatcctccactcatagcgccaattgctccggtggtgaagttgttaagaggcacgtcgtcctcatgacaattgttcaagcgagctttccgcgcgattaacgctcgcttcatgtattcaaaagtggacagatcgatggcagcgtaaggaaacatgccaacaaggccaagtggcaagccacggaaaaagcccagtaggccgtgtttgcaccacaccttcttaaacgtagctgcaatgagctggtttcccttcaggccaccttcgacggtgtcacactgcatgcgactaatgtaaagttagtttcgaaaaacaagcaaatgataccagcaaccaaaggtatgacttacaatttcaaggtatcaagagggtagacgaagcacctgcatatgtgttagatcggctatcttgcttgagaatggctactccaacgtactgtgcaaccattccaccgcaacccccagataggaattgtgatacaggcatgagacgtttggggtcaccatggccctccaggcgggcgaaagcacgctttgcagactgtcgcacgtcagtcgcatgaagacaagtttgagttgtatcgagcagttaactcacttcataagcaccgaacttaatggctgactcgggcatgactttcacaacgttgagaccgttgcctatgacagtgagaaatatgtcataacttgaactatttatgggtcttacctgcgaacaaactccggataccgcctgcacgccacagatctttcacggcttcgacgagggttttcgacgcctttcccgcagcacgcagcggagcgccatctttcgctgcgcggactgctgatgatttcacgccagtctgagcaatgagatagaccttgagtcggtccaagggcgcggttgctgtcctggacactgcgcctgcgataccaccggcaacgaagtaacctaattgaggagtgctttcggtcaacttctgttcataatatcggaaggacatccacatggcgacgatcctgggtatgggcaaccactccagttccaggtcattgtctaagggtgtagagtcatcctcaaactcgaccccaacctcggacacgccggtggcttccgcgtaggctgaaggaatcaagagtgtcaaaacgtgcactgggaaaacgttggagaggaggttctgtaaggccaagatataacgtttaagaaacgagtggtctgtacctaagccctgcagatcattgatgtggacatctccttccgggttaagatttcccgtggcggtgtagtatgacaagacagcgcggaggtttgaggacgagtaggcgggcaggaaaaggagaaaatccctggataccaacaggtcattagctgacaaccccagacaccttcagctgaccgctatagtacgtacctccactccgcataagagatgacgccatctttgttgctatcgacctccgcgaagaattcttccagccttgcgttggagaccgtgaccccggatctcgaaaaagcggtcttgagctcattcttatcgatctcgccgttgtgattgtggtctatgctctcgaacagttgccagaggccgatttcggtatgatcaacgaaggcccggaattctggtgaacattaggttggaaaaacgactggcgtctatagccagtgacactaggaggaatgagacgctatggtgtgcgacgcatgatcttaccaggataatctatgtagccatccccgttggtatccactgccttgatgatatcgcgtaacatagggtctgcattcttgagcgctgttgcatcccaagccgtcaggtcatctgcaccgagctgcacgggatcatgtcatgatggggacttacggtgatcgatcttttttagtcctttctttaggccattgaagtcaagatgaccttcacccttggtatccaagcgctgccagagttgggcgactctctggtcccgatctttttgcgactcgccagtgtccatgttcggtgaaaagtgattcttatcacaactgcgtcattatttttttaaggaggggtcagcggagttgaagaggagggattccctgtcgcaacagggcagaaggtgaaggtgagtgaataatttgggcatcgaaaatcacggtggtgaaattatgcacgaagtgataatccggcgttcatgattgtcgttgaaggtcagctggggtgaggccgatagccgtgagaaatccaggcgcgatgatttgctttccttacgacatgaaccggaagaaaactagaccccggcccggtcgtcaccaaatctcccggctattcccgtttaggcgccttccactcccgcctttcactcttgcctccagttcggccccttcggagtcccatctccgacctgcacgacatcaaacctcatcttcactccgattgctaaaaggggtgtgtgttgcctggattcaggctgttgctcccctcatcgattcaccctccagcgctcctgaactagtgggtcgtataccataccagccacacatccacacccccggatgcccaaagccaactggataatctgtacccatccagcacctcttaggcccaaagggaaaagcactatggtggctattgctacctcttctatactagattaacccccacacgatacccccttcccgctagactcccaacaatggctgctaattactgggcatcaactcaacgccgacactggctcttcacgagagagaagttggcagagattcgggagaactttagagagcgggacatggtcgctcatagtcagtttcctctgccggatcagaggttgctgaacatctacttcagtcaacgtaagataacatagtatatatcctaaatcggtgagcatccgagctcaccagaccaacagaactcatcaaattggggaaacggatgtctactcgacaacaagcacttgcgacagcgcaagtctatgtcaagaggttctacaccaagaacgagattagacatacaaacccgtatcttgtcgtcacaactgccttctatctggcctgtaaaatggaagaatgccctcaacatattcgttttgtcgtcggagaggctagaggtctctggccaggtacggaacactcgcgttaatgcacttcgtgcgcttcccgctgacgtggctacagagtttattgccccagatgtttcaaaactaggagaatgcgaattctctttgatatcggaaatgaactctcagcttattgtgcaccacccatatcgaactttatcagaactccaacccgagctgtcacttacgtcagatgaagttgctcttgcatggtctgtaatcaacgaccactatctcaccgacttgccgctcttatatccgcctcacgtcatcgctgtcatggcgattatcgtcgccgtggtcttcaagcccagccaaacgagctttcacgggtcagcagcgccactggccagcgcgatgcgcgatggggggatgaacatccttggagcattgggagataagggcggcaacggccctcctccccgcattcaacgacttataggatggcttgccgagagcgaggtggacatcaaggcagtcatagagtgtactcaagagctggtgtcgctttacgaggtctgggagcaatacagcgaaaagcattgcaaggagcttcttggacggatggtgaagagcaagaacctggacaaatgaacataccattttcatgcacatacataggatttcaagcggcgttcaacggggtcatgttattacggaagcatgtcatgcgcgagcgatacttatttttttggtccatatttcgggtttcggctggttgcagattgtttcaaaactgttgcattatcgcatagtctaagcgggtgccatggagaagatactgagagatacagatataccataagcgaacaaacagacttcaaacaaacatacgctcatcctccatattagcccagcttcgaatatcccgcatgccagtaaccgcttcaacagcaacaccataacgcacagtacatattcaaaccccaccagaaagccatgatgtttatgcgactaaatactataccctgggcatacaactccccatccaagttctccctgacacatactcaaccacaaacaagacatagatgatattcgtgtaacacaaaccaatccacccaccaactaagcttcccacatctccacaactaagatccgtaagaatccaataacaaccacaaaccagaaacaaggtcttccatgcataggcacctactgtacatacccagctgtcagaatgtggatttactccgagtcagtaagcaagccatgttgaaaggcatgtaggatttgactttcagttctaccaaggttgtcggtccaccgagtagctctttacggtggtacctacgcaattactacttcccttgttgcatgccgatggtaaactattacatacatacatccttgtaaacgaacgtatgtatgtatgtatgcgtgtatgcaagctcgtgttccttgacgaaaattctggaatgcgtggggaatttgcattctggcatgtgttggtagctactactgtagctagggatgggagggggagtcaaagggatggatgctcggatgtcaatccgcgtaagcgcgagactggaactacgtatctcgccaggtcgcggtgagatttagatgatgaccactgtgtttggttcaaccggttttgtgtggcgctatttctgtcagtttgtaggctatgctacaagatgatcatggtgggtgttgatctgggaatcgggtatatccgttgaatgtaaccttcaagctttttactctatctagtcttaccatcagttgagattgaatcttccacggagaaccgatcacgcagtccagtagtattgacaatttgacccgggcctacaaggtttatccctcgatttgggaagctatttcaattgagttttagtccgagttgacccgtgaataatctcgctgctctcccgtttgcaggtgtcacaggtaccactccagccatgcactctttctgcttcgaagaagcgccgacatacatgaacgctacaacccagatttcaggaactggaaagctacctatctggagatatgatgtcgtttattggacacctctaatgcaacatgggcgcttcctgagaccgttggccagactaggcaggaagatcgtgtttcatatcccttgcttcggggtacgtatgtgggcggagatacacttgcgcacactccagtcttgttgttgagagggggagtacccccgagacgggtagacaaggactatctatcgtcctatacactagctagatcaacaaatattccggaaatggcgtctggagtgcagcagatcccgcttcacgaccccccgcccattaagccatgtacgtatacttgtgtacactcaggccgtgtagcgggctgtgtatctaggcctttcttcattgcgccgcaaaacattcctcccaacaggatttcgtataaaatctggtaaaggggaataccaattcaataccaaggataccatacatacggcagggatggaaagcgtccgatcatagtaagtagcggcatcggatgcctcgagggtactttagttatcggcaaaacttacttgctgtatggatcatcacccataagcatgatcgagtgactataccggatttttctcagtgcgcccctgccttgggcatcgagatgcacctatcatgagatgaagatcatacaacaaggttcctgatcccgagaggggcaactccagactgcgttgcatttcccatctaccgaaagggcggtgaggtggtcagatcttagcagggacattatcttgccgaataggatcagaaatcatgtctcatggggggctggctttttagcaggtttagtttggcacaatctggacacgggagaagtgtgaggataccactctggcatccatggctagtagtgcccaatcgcttgtacagacaagaaagcgcccccattccatcccaggtcgcttgagcgagtgtatgttcctcctacctactctcgggactgcatcctgcagtagtctgcaggtttggaggagctgtgaccctgctagcatgcgttctaagcccgatccataatatattatgctgctatggctgttccagtagccgccatcattcctaccggtctgttccctcccatccccccctcctccccctaggtgcatccccatcctgcatttacgctaccgttgaccagtgatacggcgtttcaacccctgggtttagcgtgtgcagtggagggtccaggcgtcggggaaagtagaccgcaaacttgttctacgtttattggaaaggagtattgtagataatgaagtacacctatgtgtcgtgacagcagatggagttacggaggatactaaaagctacactgctgtactattcttgtgaacctttactgcatggagggaggtgcagggccatgcagtggccgtagcgcttgccccatgtggatggatgggaagacagggagcagatccttgacaatgcagagcagccaagcccagttcaagattcggttccttttgttgacggcgttctccgtacctgattgatttttgaggtgaattggcgaggggactcaaaaaacaaacagtgattacatggacataaggcctaaacgagaaaatcactatttgtttattactattccgtaatatatttctggtcagaaagtactactgacaatagtatcagctgactatccgctcaatatggagaagatccagatattgaagtggaggattaatttctgttatggaatacttgtcgaagccgtcgaagggtggccatggcaggagctgcccgttattaatctcattagtcaatgacaatcttcaatggttggggggaaaatacaaagtcagttggcccgagtccccgcccgcccactctaaggagcgcctctccctgagttgaagacagtttaggggagcagatggtgggaaaacggcaatagtaggatggaataggagcgcccccgacgagaccaagtggcacggttcaagggaaaggtaccgagaataacagcaacgaaaaaagagggtagctagtccggtggggctcaccacattttttgcaaatcattacccgcaggtgttgtagtgggcattttgcctgcttgccagcgcatgcctgtcttcggaagtgggagccacatactactgtactgttgctcttacctgcccttttccctttcctgaacacgaagtgactgggggttcgatacctgacgaggtacaggtacgacgggaaggatcctcctggtgaccttgaaaacgacccaacacagggagccactacagagcattgccacgatgttctttgccattgccatcgtcatcatccatgcatccgctggtgggcgagatggatcgattgatactctattagcattgcagatccacatgtctgtaaagacagtgtctgtctttgtctatctaacggcagtctgcatcatacaatgagcgtaagtaggcatcattgcaccatcatatgtaatactcatgggctgttcatgacggtaatacagccttaaagtccaggctgagacccggtcttcatccgacagccgcttgcactcgtcacggttagatcgaggacacccatatattaggcgtcaagggagagggtgcgctggtccatacccaaagggggatggtgtgcttcctttcgacgtcactaagacccgcttggtagccgattagagcagccaaaatcggtgttttattggcattttgacggtggctgccatgagcccactatgactggttctgattggtgatcggggcattaacttgccactgaggatccattgacagggatctggttggttctcaccctgccctaaaactgggtgcgtgaccaggttagcgcgggaattctgggactaggatgttacagaagttacagacgataccacggatactttacgggcgcctcggcgagggagccagttgtaaccagtaatgtcctttcataacctccatactcgtggatgccaccggtagggaaaaggctgtgtggtaagtacggtcacgtatgccattccctttcccttgcggatctccaccgacgtgcacttttgctcagccccagtcgaatcacaactgcagcccctcttgctctctctcgcctcccgtccgctccgggcgctgcgactcttttctcgctcccggtcttcttttcaactcttgtcccgccatccgttgatgattccccatcccacaacactaatcgcaaattcgcccgccccccccgatctcttacactttcactctcgcattcactttccattatctctcccatctttatcccacaatcttctctttctcttcctattccaaatcctcttctcttgtttccgcactctgcattccgtccgaccgcttgtcattcttcgaccttactactccgtctcttttctttgttactctactccggagttgcgttactgtcgggattcctgagcgctggtctttgtttatatccgccctcgaattcctcagcatatccttcgtaccgatataacttcgctttactttttgttgcgttcgtttcgccacaaccacacaacaaaatgtctacgttcttctacggtcaccagcaacagcaccagcaccagcaacaccctcaccatggcgctaccgcccacatggccaactcgaacaatcaccatgggggtcgttcccgtcggggacccaagatggctgcccagaatgctcagcgccagtttagaggtgtcaagagtatgagggagcttgcagaggcccctgctgtgacggctttccgtgcccgcttcgaggctggacggtcttttgacctggatgacgacctggagttttgccccagtctcctgacggaagatgatgtatgtttgtcgaaccccggcctagtacaccctccctctccgttcgtactacggatatcttgactgccgaccccgtactttaatggaacagcttgttgacccctgatattacagctgcactccatccactctgcttcctcggatcggtcatctctctccagtggatctcccgatacctctcctctccagcaccaaatccagcctgtccagcaggtcactccctccatctccctgtctcctgcctccagcaactcctatgttcactcaagggttagcggtaatcttaatcacgtgaacttccagcagccgtctgcagtccgcacccgcaaggttatcccgatcgtcaaccccaataccggcatgaccttgacgagcccgccaacgtcaatctccccggcttcgatgcagaatgcccaacgtcggtggtgaggaccgcgattctggcaagtcgccgttccattcggcaaagggccgcttaggctcatagcatgttcaccacgttcgtccggcttctgcatcatcgggctccctaaccgcgggttataattgttactgctttgttttgctttctgttcgacacggccatcgcattcttacgattcgactgatcttcccttctcctctttttggcttgacgagcgcaaaaacagcaaaggataaaccagtgtttctctgtatatacaccttacttcgatgacaacttcgagcaacttatacctagactgatgctttcggcttcctgcgagcgacggcgcctgcgatattcgatttttgcattccacctcaaacgataccttgtttttatcttacggttagggaaaccccttgtgctttgaacctcgattttggccgcgatgatgtatagaaagcgcggcgatctgccattcaggcgcgcatctatggtccggagttgcttttttggtttcccacggcggctatgccagatttgctgttggcggttatacctcatcttttcggcttggtgttttgtcacattttgggtgggatggatcattttctcatgcttttcagggatttagaaaggcggaaacgacatatacgtctgcattgattgggctttgctgagttgtttgggatgtttggctggtttcgacctatacttcgcatatgttttcatttcttgaaaaattctgtttgttataccaatgtatatgggttggttggggaattggtgacacgcggtgcttgttactttcaggtcaactggctgtgaaaatccatggattggatgaggagtttctctttatttcctttttttgccggggtcacactcgccttctttcgcgagatagaccactgtcttgatgggagttgtcagttgacgacataattcgcttctgttcgcctccacgttgattcgttcggatgtttttaaagtcatgttcttcgactcctggggactcccggagaatgtgatgcagtgtatgatcttgctgattctgttcgcttcttggttattccgtctcttaccatatctcctttgtctatacgctttttggctggaactatgggggtaatgcctatacatagttgtgaaattagctttggactccattcaatcttggggcttgccttgaaaacagtagatgcagtagatgtcgggatgataattttgtggtagttgcagcggttgtagtacttcgccacatgacctcataatctggggcgatatcgtatcgtgcacgctgcagattgagaggggcaatagagcacagcggttgctatcgcaacggctactagcttttaattaagaagtggttatcagattgccgcgctttagttcgggttgaggagtgaacgctcgatgctgttcagaggtctaggcggatatatattcattgctgagacgggtgccgagccaacccacaacgctcaaatcaccatagcactgaaaacatctgaacgcagcgactgcacttgataataaagataattagtagtgttctgaagtgaattctgctacacatgtggtggtcccctacttatctggtcgtaacggcacagtaaggagtggtcaatgtacgtgatgtcatatccttgatttgcggcctcgaacctggaagacaccgaagtctcctgcatccagaagcgaccctttcaaagacaatattcgaatgcctctttctattgatattacagaataaacataaataactaaattatattaaaaaccattccttgataaatcaactaaaaatatcactcaactacccacatcaacaccgtaggatataacggatagttaatggggatacatccatcccgaaacgcatcagactccatgacgtcaccgctacttcgacgagcaattcgtcgaactggcattgagtaatggctgccaactgattcacccgaggtcgaacgggactctctttccctggaattgatgattggcagttggagaaagtctcgcttggagtgaaatgatttaaatacatgaggccgccactatcgagctacttttggttcatctcgatactatctacctatctatcatattgttacatctagagattgtcacttgtctacacgatagtctcaaaaccatcgttcgaaattttgagagtactctttgagaattgtaagtgaactgcagtgcactacttatctggaattgctgtcattagaagtggaaggagatggtagcttcatactacgggctcctcgtcctcagtcaaccatccattctcttctaatcctcaatcaaccaaacatcaaactaacaacaccatcaatctaaatctagacacagctacagctacaattaccaacatgtccttcctcacccccatccgcgcaaccaccctccgcctctcccgccctgcctatgcctacacctctgcagcagccctccacaccagcattccccgcccaggtctgaaggaatccgatcacagtgagtccagtcccgaccaactctctcagacacattctctaatatagttaaatcattgcagaccgtgaagaccttggcagcatctacgaagccgagaaacacgaccaactgaaaagcaccaaggagggtaaggcgaagtggaagcaggaaattgctagtgatagtgaggcgtcggtaggtttctctctattctactcaacaattctaaccccttctacggattgggttggattacattaaagggtgattgatgctaatgtattgtttcaaatgcaacaggtcaaggccgatcgcggcgaagtggacagtgacgacaagaacttcggagccatgcaggaacggacgaaagggttgccgaatagggatgggcccgtgaacaagactcaataaattgtttttattcatttaacagtacttatgatgggtttagtcggttgggtttgcttgagaatgtaaatggaattattgttcttgcttcattcagttcctggtgttgttttttgggtcgggtgggttaaggatgagttgttgggaggttgatgtgatgggtcgtttgttgtctacttctaagggatatattcaaatatggtattatggtatcaaaagcaggagagatgtatttggctctgctataaagtaatcaaaggaatgatatatagtgtattcgaaacagatgccgatgggctgtaaaagtgttaagccgcaagcaaatacctactctaacgccacagaaacccttccatcctccacaacagaaactcgatagcttagtagtatggaaaactccaatacaacgcaaataacgccatttcgccccggggatcatcaatggagtaatcccgctccaacaacaaagtcatgacgagaagtatcatatacgagaggttccacacccattcacttgagaaggacgatcagtatgacgaggacgatgatcaacccgatgattgtcatcatgctccaattctcgctcgcacttcgccgaaatttatccagccggcgtttggccttgtctaaccgaccctgatgccgttccacatggccatccatgtcatcgagcaacgcaacatggccctcaagttcatcaccaatctggatactgagttgatgttgtcgtccgatggattcgcctagtcggtctagctgctcgtcttggtcgcgcatgatctgctcatgatgatcgtagacctgctggttggacatttcggatgtgtccacgccctgtggggagggcgagtcgcggtatggctggaagagattccggcgattgagatcgtcctcttcggcggcgttatccataaaccggactgatttggaggaaggatgttgcgggacgggctgtttcaggtccggtgatgacttcttgatgttggtgaactcgacgggatcgtccgctgcagcagcatccgagccgcggaattgggatgtcagttctcgatactgggagtataggtggtcgagttggtctctcatgtcggtggcgctttcatcgttggcttcttctagccgtgcgcagtcggattccacggcgtcgatgccctctttcaaggagtcgagggagcgtgagatctcgccatcttgactgttgggttctaggtcgagcgagatggcccgttgccgttcgagtagcgataacttgatatggtcggcaagaagcaggagttgcgaagggtttggcatggctgagggactgagatagcgtttggatgtgcgtgaggatggtatgggggaagaccggatggaggagaggaggatggacaaggctgtgaggttgtcttagcgtcggtcaaccaggcaaatgcggagatgtcggaaccgcggcgacttgcagatgacagggaaggggggagaagtacatccacgcagggactgccagacgatggagcaatggagtggatattactgaagccagaggaccagccgggtggatggaatggataaccagaggccctcgttctcggcagatctgccgcttccgccgccatcgtctccatttcccatatctcgccgtcattcatcgttatccacattcattcctctcttactctcccccgcaatggcctcactttcctcacgtccacctcctgcggtcaccctccccctgagtttttgttctttctttagtcaaactttcgtgtcagccaccgtgtaactttctgagatacatgggtgttcgctttgtgctattgtttcatcgtcccacccctgtggcatctggacggtcggtcccttcatttctggcccccctgtgcaggacgacttcgatcggcgcacgagcccgtggcttaacaatataagctgaacccttcctgcgtgggaaggggggtttggaaatatgacgagcatcaccctcgatgaactgctcgcgatggaggcgaactgcgaccgagacgaagttgtcgacttgcgctcactagaactggtctccagctacgatgaccacctcatgtgcccgatatgtcactgccctttcgttcgccccgtgcgccttcagtgtgatcatgtcttctgtcagaagtgtctaaatactgccatcactgcgttttccgccagccgagacgacttcacctgtcccacctgccggactcccacgaggggtgtctacctcaacgtgcctcgtctgctactcaatatgtgtgatgatatcaaagtgcgatgtccttttcgggatgaaggttgcgaggagattataccaagaggtcagattcagtctcatgtcgacaagtattgtggctacaggctcatgaagtgtccggatagctcttgcaacaagacgacccggaagaaggacctcagttctgagggccggtgcttgcatgagcttcaacgctgtctacgatgcgacgagtatgtcgcggaacaagattacgaggtatgggagttgccttcataccatagaatactgctaatcagatttctttgtctacaggaacatgtcaaggatctatgcccgagtcttaaaacaacatgtcccgactgccagataagcgtcctacgcaaatcactgcgggaacacatcgactcctgccccgaggttgtccatccttgcgcggcctcgaaatacggctgtcccgtcaaggtcaagcgtgcagacctgacgacacacgaacagacttgtccgctgatagccatgggcccgtattttgaagcgcagaatgcacgactcgattctcttgaacttaccatccgtcaccttcaacagcggaacgagattttcgaggacggaatttccaacatccgctcgacattagcccagtcgactcgtactctagccgagcaagatcccccgacaaattccgatgcccctcgtcgacgagattcggcaagcaatcaatctcagatcgacagctctaacctctatactgccactacaacgaactacttactctccctccacgagtctcttcgcgaagaggtcggacagctctccaacgccatcacagatctagacgcccgtgctagcatggctctcatgaacgaatgtcttcgcttaaaagaagacatggcgcacaccaacgcagccgtgggcagcattcgcatgcaggtgcagtggctcttgaaccctcgtctgcatcagggccagcgagcaggtgcacgtccaaacaacgctagtggcagcaacggcagccctgcgtctgcgtccgggccgagtagtgccgctggtccttctactgcttttcttcgaccgcggagactcagcgatagcggacgagaggggaccaaactatgatagacggcactcggtccattccattggtgccttgtaaatgggtaacgctttttcttactcccttattcttttcctccgctgtccacttggagcccacatacatgtggttaatgaatcggtgcttggcgaatgcatggctgcgacatgatgtgataatgatatccttttgctttttttttggccttattggttctgcttgttcctctccttccatacctgcaagtgcaggccacatgtggtgtggctaagtgcctttatgtgcatacacattaaactacagatatccggcggggatatgtctcatgatgcactcttgctctgtgtgttgttgcactgtacatacgttttcagttttgaatgtacatactagacattccgggtgtctcgaaccagtgctatttacacaatatccactagcttgctaggaacttactgatcactactcagtactataccagcgaaaataatgtccactactcctccccaaacctaacaacaaccccatgcggacataatagagaagacatgcatactagtctagtcatcccactgccctactcaccaattgctattccttactaccatcccagtaccacgtactggtgctacttactcacagcagacggtaaaaaaaaagagccaccgcaaccggtagaccctatatccccccccaacaaaaaaaaaaaaaaataaaaataaaaaagtagagaacaaaaagacaagccgaatgcgggtatcgaaaattgatattgaaataattgattttattaaaactatcattatgaactaagagaacgaatatcatatcatatattatataattcttcgagataatcatgtactaagtaatagtttgataaatgagttctgatatgatccagcttctgtcccgtgacttttagacacacacacacacctattgtatatatccgactccagacgaaatatctactgttctacaacccaaaactttcaacccagccttttcctagtcttgatatgccaattttacaaaccgactatcaccgaactagcccggctagctcaatcggtagagcgtgagactcttaatctcaaggctgcgggttcgagccccgcgttgggctttcttttttgttttttctttttgtcttttgcctcgcaagacgttggatactagaggtagcctagcctggctttggttgttgaggaggcttgatatttttgcgtttgagccgggacgaaattccttgcatcttagcgtagactaggctttggcttcggtgaacagttaactaacagctgggcagatgatctgaattcgcttttagggatggcaaaatgttatgtatggtatggtatataatgtatgttcttgctgtaggaagtcactattatttatttatataataggttggttgggctttgctaagacgaggatctactggcatgagtctgctagagggtgctctgaagatctagatgttacatgactaagtgaagagagaataatttctgcggagactccgaaaatcatatcagtctattgcatgctaaaataaagtagtacacttgctagcctagcgattcatcaatagttccctccataatagtcctgactatgtccgttcccgcgtccataactcgaataagaactgtaagactgctcctcgtaacctccaggcgggcccggaggaggaggtgtgcgaccaggtgatggataatgatgatggtggtgactgtgatgttgttctccatggtgccttcgctgacttccattgtattcatcatagccgccgtagttgccaaagtcagagggagggggagggggtggttgatatgattgctcctggctgtgatagtactgactctggctctggtattggtgctggtagctgctgtactcctgatgcgaggactggtgatgcgtagtatattgagactcctcacgagactcataccgagctgggttctctgcttcttcggtctcgcctctcgtgccaccaccaaccatcagattggagaaggcgctgttcaacttgttgaggttcgagatccccggaatgggaaggctggacagcttatcccaggggagaggagaagagccttgctgttgctgctgctgctgctgctgctgctgaggcggacgctgctgctgggatccgtggctatgtcctgcagcgccaaaacccccaccatgtgagtgtgaatgaccctcctcaccggtgctgttctttccctgtcttactccctcagcgctgagaacatcgttcaggtcggcgccacggtccggtctggagtcaacccaggcttgcacggctttgaacattgtgcgatgggcttcgttgttcatgttgcgcagcgctgggtggtggaacaccttcaagcaatcttccaatacctggtcatcggagacgtccaggttctgccaagcgtacagaacccgaggcgcaacgtacttcaggatagcggaggctacctgaccagctggctcattgagaatgttggagaagtggtccttggagagtagcgaatgggtaggatccgtgcaattggggtcagtccaaggctcatactggtgctttccggaggcatcaatcactccggaagatccagcttgcaaagacttggaagcggcgttgatgagggggcggataaacggtgccagtagagacatgacgaagacggtcaatgtctcagtgatcttctcaacgattgcctccaaaccaggaatcttctcgatgatcgacgcaagcttgcggacaactttgtctctgaactcgaggatgggatagatctgggcaatggtcttgctgggatcgaagtcctgtagagccgatccggactgggaatcttctccaggtctttcattttcgttagccctgtacgttgggacctcgtcatcggatcctctactacgcggagcgctatagtcatccacctccctagagacaccgcgcgtagtgtaaccagaacgagcaccataagaccggttcgcagactcctgagcttcggagcgacgcttaagctcctccgcctcctccaccagatcctttgtaccggggatatttcccagaagaccagtgaaagcaccaagggacccgccagaggagtttgcctccgcatctccgagagcaatgtccatctcgttgacttccgactgagtaaagtgatcgttggcttctcccagcacagagtggaaaaagtcaaccataccgaacgttccagtcacaagcggaaacacatggtgaccacggacattcatctgagtgttcacaccagtgtgagggaagacattgcggaaacccatctcacgaagcgcaagttcaatataatttgtatgcgctgcgaaatcttccaacgtatggagaccctggcccagacaccgaagcgcttcgcagagatcttcctcgtttcctttcttgcttccatgggtatatgtgcgtccgtaatgaatgctgcgagccaagctatacttgatgtaagcagagctggtggcccatccgccctcctcgttcgcaatgtagttcttcattccggtctcggggtcgatatccagctcgacctggcggacagggcctcgcagtcgttggtcgaactcgcgagcatcctgattatcggcgtaatccttagggttactgcggagatgaaaacataagcccgcattcaaatatgaccacaacatacgaaagacaggagatagacatactcaatatgctcctcaggacgataaacacccagcctctctgaagtgacttcaaattcagccgtcgcatagccaaacgtcatgaaagacagaatccagaccaggatccgaatagtctcagccgggagactcttcagtgtaccgacgtccatagcttgtgagcttacaacaaagaacttcaatcagcccgagttaccgtcaattactggcagaaatactcactaatcgcgcaaccagttaccaaagtacacgcgcttgaccatcatggaggtccacttatggcccttgatgaaagcgatggttttgagcatatcctcgatatctccatgacgccagttcttgccttcaacagccgagatcgaagcgatgtctgcaagtgttagtaaaaagatgacgcacgctgaaaatattagaggaaagcttacttccagctccaaaagcccaggtctgggtgggaagaagaacaagcagcagacccagaacgagcagggcgtgagtgcccaaactcattctcggagccatagctgtaggtattgttctgcggggactgtagtaaaaagaaatgacaggaaagagtctagaagaatgataggctgcagaaggggaggacgtgcatgcagaagcgaaggaggggggaagatagtaaaagaaaaaaagccgagagttatcttatctgcagaatcaactgacagaaggagctagttagttggacaaagacaagcgggccaaattgggagaagctcaaacggcacgagagcgaggggtacgtagtccgttagtagtgatttgatgaacttgtgtgtcatcgatctgcaaccggtgaccaagctagaactagattgatagatctaaaggactttgacggaggaggggtgaaaagaccctgaatgccccgctatccagtcagtgggagaccggatcattgcgatgatatgatctgttgacggtggcttagaggccgtaagctcggctgtgagccctcccactctttcagatgacacttctttgccagccagccagccagccagccagccagccagctgaaaattcgcataccataaatacaagcgaggtgttgtttttccttcccgtaaagtggtttcagtgggagccatgggcgttgtcggtggctttgcttggcattacttcatctgacattgttgatgtttttttttttttctcaacgggactgtagttagtatactgatgaggtacggagtacatgtttacgcgataaacaacacatatagagacaaccacaatatcaccctccccagcgtataactatgcaaagtagcgaaaggattattgtgtaagcatattcattcattccgctcagtcaccgcagtcaccgctatcgggacggggcttgccaagtgatggctttcgtcatatggcccttgctctgttgatcgtcattctcggatgttgggaaagtgggcccttttcaccagccactggactcgtttcgtccactgtatttttcatcgctcatcgtgactgaaatctccgtagagcaatgaaatggaattgtttgtttgcatgacaatactggttcttttaaacgagactaccttgtatactagcccactgaatgtaaccatggaatgaaaggtcagtgcagccagcttactttactgcaagttcttccccgccctgatgactgatcgatcagggattaatttgtgcccgccgcggggtaatcaatcaatcagcgccggacttgagcccattactcagaactaccccagtaaccacactagttatcagtgatttagctggacttttcaatgcttatcagaccacacaaaacaaagcaattcttcttcaggtgaaagggtaacatgtgctgacagacaaggtagcatcgcgtataccacattgttgtgtaatgagaacaacaacaacccatatactagtcaactaccagtgatagaagacaccttatatatataccattgtcccaaactcaatcccatatctcttgtagttcactccgagtggaacaatcttttcttccccgtctagctcactcccccgccatcaccccgacataaccaccaccaccaccactcttttcactcaacaaccaccacccctccaacaccaaaagctacaatgtcatcaacccctcacctcagcgccctccaacgcgacggcttcgtcgtgatcccctcgctcctaacccccaccgaaatcgcccactaccgcaccatagccacccacgcgaccacgctcacccggacaggaaaatggccgcacttccgcaccgtaccgaagcaatttcctccctggcccacgaccccgccgccagcctcggaaggcggaatctggggtgtgcagcacctcctgcaccccgagatgccgggacggagtgaattcgccaagttctatttctcggagaaggtgcttgccgtggcggaggagttgcttggtctgacatcagacaccaacactactagcaccaatggtgatgctcccgagccactcgtaatggaactcttcaacctgctcgtcgcgcccgaaaccaaagacttcgaactccgctggcaccgcgacgacatccccgagaccgcgaccccggaggaagaactaaagatgctgcaggccaagagtcccaatgggaagcagtcgcacgcgcagtataatctggcgctgtgtgcggattcatccttgattgtgattccggggtcgcatcgacgggtgcgcacggaagtggagcgcaatgcagcgccatatgagccggagttgccggggcagttggtggtggagttgaagcctggtgatgcggtcttttatgatagtaatattctgcatcgcggggtgtataagtgtaaagaggagggaggggaggagacgaggctgacgttgcatggcagtttggggttgaatgcggcgggtttggcggcggaggaggataagaaggtaagggctacggcggtgttgcagcatggggtcggggcgtgggtgcatcgggaggatgctgcttttgggattggggaaagggcggagaggatgcgtgcgaatttggtggcgatggggagtggggagggggtcgggtattctttgcagggttgagaggggtgcgttgagggtgagtgtgttttgtaaataaagaggaaggctatggatattagacataggcataatgtgccaccgaaacttctattcgttaagcatgcatatgcatcgagctcgaatatcaagaacattcatatatatgcccagaaagagggtatcgtcataaagaagaacaatgtatccgccgctgttttgacgccagaaatgtaaaagagcaaaggcataaggcattcacggccgtcacatagtctaatcgtatcgtcatcatccgtctaatggtcgctgtccatacacataatggaagaaaatgtagatatgataggtcgaacttgcaagctccgcatgcaccttcttcacgaaagcttgagcctcttcatacgagtaacccaggacccgagtccagagagctagcgtatatggctcgaccgagtcgtataatatcagtttccctactcgtccgatctcttttagacgaggggactttggccacgtgcctacaggacactgcttcaattagctggaatttcgacccaaatctttatagcagactgaccttgtagatatcatccacaacgttgacaaaaccagcgcgttgcatataacccttcacttcaggagcaatgttcatgcgcctgccgaatttcgtacttgactcttccagcttctgctgcagctccctcaccataacagcatctttgcaggtgccgtcgtcggaatgtatccacgtctcggattcttggatttcgacccagccgccgggcttcacgttttcgtaagcctgacgaaggagctggccccagtcggcaatactgccacctaagctgcgagcatggatatagtcgaatggctcattgccgatgtaggcccaatcactttccgcgtcgtcaaccagaaagctacaattaggcggcgcccacttgggctgaattggactaaggtcggtgcccacaatctccgcattgggaaagtcttcggccatttccagcgcccagatgcctgtcccagtgccgatatccaggatgcgctgagggtcgcctatcggggcacgatataggtcgcctcccaagaggagcttgaaggcatgatgcattaaagtgaggcggtcctgctcttcttcgtcgttgggcatgggatattgcccatagcggtaggcgtgataccggcggccattttcgtaacagtaatctcgtacggatgatgttattgaaatattggattcgataattgattgttcatctatgagggagtcttcgtcgcttgtctgtaagagtcagtttgatgaccgcgattgtgcataatcatttcggatacatgagaattgtttgagatttgcacaaaacgcatcacacaagagccatacacagagcaccgtaacaaatttatcgatgtctcagtcaaagcgcccagtggctgcataagtaaccggaaaatctcgcaaaagcagaaaacatagaaattgcgtataaccgtcagaaagatgggggaactatcttacatctacctggatgtgttcctctgaatctggctgtggcatgtttgaaatgacgggcggagacaatgcgggagggggcgtgaagagggagtgaggagagaggaataagtgggatctttaaacgatgacacccgcagctgtcggtttggtacgacagggagttgagtagttagcgaaagaaagataaatgtaattaagaagttagataaataagtgatggagcaagaagtgggaaagaaacggagcaagaacagagcaagcgcagcaatcaacccaactaagagaaagagagagcgcgagagagagagagctttaggcaatggctacttgactagtcaactactactacaagataggataactaaagttccaggtaagatacgggtaactgcggcacggacagggggaggcggtcccggggaacaggccctcgggtcggtgagcacataacatgaaggtagtcagtcagtctagctgaagtctagcttggtgccagggctctgggtcggggttgacgcccggtattgcttggtatcgtcagtcactttctcaatcccgtccccttttgctccctccattggttggggtcttttccggactgccatcatccctatggagaattggatcacttccctactaattaaagttactaaaatgtatctacttttaactaactctctttcttgccagcacagttagatgctttacacagattggtccaaacagcccgcagttgctaaagtacttactagtgtgtgccctaaatgatttggaattgatcctctccctccaggcttcccaatcccctcactctggttccacgctagttgggatctcagctgcgtagtttatgtaacctcagacgaattttctccgcacgcttgtggatgtggctgtagctaactatttactagtgattaattctaccaagaaaacatacaaacgactgggattaacctgtagcaaataccatggtaatcacctctacacaacaatgatggataaatactcataaaatatcatatatgatcccaacttctacagaggaagataataaagtcaagtgtgtagcagtttcccaaggctggcagccaagctccccccctcctcctccccagccccgctcccccgtgacggctggtcccgtttcgggatcccaatcacgccagttgatcagccacttcatcgcatgcagctacgtactaactaagcagataaaccaacttaagtgctgatgctctgggtcgggtctatccaacctagtcacgatgggtttctccactaacgatagttaggcgggaaaaaaaatggtatgataacatgtctaacagtaagcgagaagaagagagtgcaaaatcaaacctagtctactaagtactaactcacccaaccttactaactgctagtctgagggtaaaatagccgaggacaaatgacacaaaccccaatacttactatttgtgcgatgaatgtgaaacgtacacagaatgataaggatgccccagtggtagtactgcaaatgcgatggtcaagtccattacctgccagttggttcccagggatcttacacatgcgaattaattaaaaaaaaaaaaaaaaagatccctcctgcggtgaagccattctctactgtagacccacaaaaactgaccgtgcccgccactctctaaatcagcacttctatcaactggttcatgagcaatctatcttttttcaagtaatgtgctctgtagtaggccttgaaggcgagtactcatagactaactgcaacgttcataccaaccttcttatggggcagcagacacctggatcactggatggcctagtacttagtgtgtgcactagggatattcttcctgcaggaagcatcatcgttcgcccacaaacccccctcctcaagaccaagcccgaaggagtaaatgcatgaccatcggaatgacccggacagccggctacgtgttggtttgttgtcagctgcaggtatccagctaactactagcatgtagactaaatgctaggtgaaacactacaggaatggtgcatggcgccgttgacgtttcttgggtcacgtcggactatttttgactaccagatagatggatcatacggaactgctggatcaagcgcgctgcctcgtcggcactagcagtattcattgccaccactgatgtatcgcttgttcatacaatcattaggtgtaacctatgcgaagcattcaacacgtttcatatgtgattcccagcgtcggctgagggggggcataaacagaacattaaagaaaagagaaggtaatatttgcccataatatggtatcacctatcgacagctgacaagccggatcagttcaaactttgcagcttctcctgctctgccggagtcaaggctgcatagagctgctcgaactcaggcttagtggctgcgtcacggaagaagtccatcaggaaggcctgcgtttcgtcgtcgcgtctgcgtaccccgaacacactttccgatccgccctcgccgaatgccatcagctcttgcttggtgacaccgagattgagatcaagggtgttgccgggcatatcttcccactcgtcgtcgtcatcgctatcttcttcctccagagcagccgctgtggccgcatcgatttccttgctgccggatgcagcagccagctcctcaacaagaaccttgactatcttcaacggagccgtcaccgtagtgtatcggtcagggttgttgcgagtctgggatcgcgtcttaatacggccagtgtcctggataatgagatctcccttgacctgcacctgggacaagcgagggtctcccagcctgtacagtgttgccagtgcaatgatattctgtttgatttcatcgtagccagcaaagttgaccgagttctcgagccacttgctcagcactatgggaagtccactctggccgccgatatcgacttgcgcaaggaagtccacaacctcgcgtgcgctgatcagggtgagtcgtgcaaatacaagaatcagactctggatgaactgagcctgctccgcagtagccagtcgctgggccacggcacggagaagctgcggtagataggggccgagacgttcggagccggccttttcaactaactccgcagccaattgaccaacctctgtcgccgcattgtcatcaacagaaggtccgagtaagcggtcaattatgatcaatgcaacctcagttgcttctttaccgctctgcgggtctctccaagcgacaaactggttgaagtcatgagagagcatatggcggactgcttctgtcgccggacggatcagctccgcgtcggacgaatcgagcagcaggcggtttaacttcggcatgaccgtttccacgaagccggctggcaagggttccaatgctccttcagcaagagcacggagaaggtccgcagcaaagttagtcagagcgttttcctgcgtgaggttgccgacgtcgattgccccggtcagggaaggaagaaccttctcgcatagtcgaacgaaagcctcttccccgttctctgcgatagcttcaactatgtcctcgaatgcttccgtgacgatcatcgtcaattggaaattggtggctccgctgctggcaacattgaacagtagatcaatggcggtcgacgacagaacgacagtcgggtggaccatgatcgtatcgcggagcgtttcagcaatagtaaccttcaggtcttcaccctctgactggtcagacaggtcatgtgcggatacgaactgcgacagtgctgaaacaatagcaacttggagagggaccgtcgcactggggggaagcgaaggcataaggtcctgcagtgctcgaatacaagcgaccctgaccacttcagactcatcttcggtgattgctttgatggtagcttcgaggtaagatgcagccgtctgctggaaggagtcgccggcaacctggcacagaattccggcgatgaggtagccccgcgctctcaaaagatcttctggttgctggatggaatactgaatgaagttactgattccactagccaagccggcgggtatatcttgcgaaacttcgttgaagtcccggaggagctgattaagaatgtagagggccgattctttcgatttccaccttcacggagaggttagtcttcgtttgatgcgttagggaaaggaacatgacttacgtagaggacgcatcggagaacacagtgttcaggtacgcgtggagaccctcaaccgtcatggtcttgagccattcaccaagcttgatcaccaaatctccactgcatgtacggggcgtgtagttggcagtaaccgatgtctcctccgagaggaacagagacacatcgatatcccataggccctcttcctctgatgtgatctgagcataagaggtcgccagtttcatgatttcgggaagccaacttgtcgttgccgcagattgcccagcattctgtagctgctgttggagctcggccttgaccggcggcgcctttaggagcgtctgaattagatcaagttcctccagaaccaagaagtccaatgtatacgggagcccgtcgacatcctccatacggccctgcctctcatcctcgatgtagaactcatggtaagcggactggatgttcgaaagctcggtccagatagtggaaaagtatacggggctttgagccgccaacagacccgggaataccatgcgaattttcatcaaggtctagcaggtcagcgattagcgtgaaccagcaaagggggcagaatggttatataccttgaccacttgcaatttcaatccaatgacacctctccacttggagggtacctcagcgtctttagattcttcttgtgcactaggagcttgtggtaaaggtgcctccagggtagaaaggaagaatggagaccagccaccaagtacttcgtccatgaaccctttgacagccgccttgtgctgctcgaggaccatttccaaagtatcaaagcaggcccggaaaactgcaacagccaatgctcttagcatcggctttctcgactcattcgtagcgacgttgtagaggctagtaacgagatcccgagcaacattgaagaactgttcctcactgaatccagtgtccaccagatccaacagaaccttcagtgcaccgtgaagcgcactggcggtgctgttgccatcgtttataatgcgaagcaaatcaggcaatagttctggccactgctcggggaagtcggcgctagcaatcttgctgacggcataactggcagacgacttgactttgcgctccggagtctcggtaacggtggctaagtccagcagcgctcgtcgaagctgggccttgtttgcatcgctgaccagaacttggcctttgaattcatcgaggactggtgaccaggatgcggctatgaaggtccgaagaacggaaatggcagactggcggaggttggtgggaacggaatcgtgagaggctatggccgcaagtgttagagggaaagtctcgttggaataaaggcgtagaagctgaagctcagcagactttctggtatcggagaccggcgactgagtgtctgcgagcaatgtcaggagctcttgctccatgttgataggagaacgtaggtgagtagacgggagagtgtcgatagagggggtgtaatcaacgaatggtttaacaaggggcttggatctgaattcaagcccaatcttcggagtcctggcgttttagatcacagcagacggctccgtcaaaccacactattggtaacacgagtatccaggtagattgttcaaatcaatatcaatcgcgaaatgtcgcgtcgtggaggggcagaagacgagcgggaaaagggaggcggtgaggggtagaatttcccccaaatcaatttccagtttggtttggtttggtttgtcccgccggatacatgggtagcaactgagacacaactaactacggagtataggtaagttattagcgcttgctgtcaaccagactatcgaaccctccctcatccttgtccagctatggttgtagtgtgctgtactttggaacgccctattatcagcaccgtatttacatcagccaaccttgcttatcataaacagcttgtcccaggacaatagcagccaagctctacatatcttccgttttcagctggctgccagcaatagaagaacgggttaaatctcgaaatgcaagacttgggagagtactccatagtagaagtagtcttcagtttccccgtgtcttggtccccgactcacgtcactgatcatcggagattaaatagcctaaagcctacaagcaacgtctgagtatcacctcccaacgtcttcgtactttccacaaactatccgggattgaacatcatggaagctagggatgacaataccgtccacttacagaacctcacagaaaccagtgtattgcaatatagtttgtctgaagtttgttatgcgtctacgcagacaaccagaacaaagatttaggcatccccaagcagccacattcaatagtctgacaacccccggtcttgaacgataggttttggatgacctccgagaccggagacttggttgaacaaagtacctgcaatggcgggtgtcttgctgacccctacgttatccggtagaccttccaagagaaagatacagccaatacaaaggtctgcctgatgtgccgcccaattaaggaggaggaaaagcaggtgctgtgtccactgaagtcatgagcgatcaatggcaggtaatcgaatcttagtggtcaatactatgtgggtagatctggctcgcacgttattagcaattgtggtccgctagtatgcccaatacatatcaccttaggttgtagataattgctagggatgggggaatgatgacattgaagtgcagcggtgcgagcctcttagaccaagaagcagcagtagttaattagttatgtgaaggagccgggtctgaatcagaggcggcatttgtctcagttgctgatctgcctaagtcgaagttttctgtggagaagatctggcttcaatccaatcatagaaggaggaaagaaaatcccttggatcgttgtaaatccattctggggccacttatgaagtgtgtgatgatgtagagaagcaatagatttcattcttctgggttcctgcactgtacttttgctccaggcgcgtattcgtagcccatttctccccaggctccatacgtgcctagtggccagatgtatgttttatgtactatgtatcatcaactgtgctccgtacagcggtgcagcaaactttgggtagtgatcaccggggtagctaggtaagtggcgtagatgggactcgatgcatttctgaaaaggatgacaggaaggaataagaagggggagttgtgagtcgatcatagtggggttgatgaggataaaccggcaactctgattatctaacgccagttgaggggtggaaccgcccaaagaagaaaagtaccgcatgaaatgtactcccggtcgctgtatggagtatgttatgtccatacatactcttacacaattactcatgaaaggtcgaataccatacagttaaaagtagcctcgggtattgtattgatggatcaacgaggaacaacctagaaggcgatcgcgtgtgctagagcaattgtgtcgagattctaataataatcaggtatcgggtaataatgcgaactggcgaccttcagggccatgcataagacccggaatccgcagcaggaggggtaagctcaaggtagctctcgtatcgcacgcactaagcattcttcaacttatccttcagacattccggacggtgagggacgatgctatggccgtcagggccatctacctctctgaaggtatactgttcggccgggaggaacaaccggagtagccaatacatggaacaactgcagaggaagtagataaattgcaatgtcatggtcaaatagctaataaatactccggactatactaaacaaatattcacctaggtaagacggattgacctacttaatccccggagcaagccagatttgattgactgaaccttggaaacctcgggctacgtacgggggaaaaccagagtagttgttccggctttgtagtaagatttctgggacgactagctgttttaactttcgttccttttaatctctcggaatcctgactaattattattgttgctgctcctgtcttctaccccggtcacctacgtgtcgattcaagtttgatttcatgatgatcggctcagtgaactggagtcagtcatcccactactgacgagcctgggtcatattgtcctgtactggcgtggacaataccaatacggcgcagatgcttacttacataccgtcatgcatactgtcatactttgcccagcgataatcttttgtttccctttgctttttcctttgccaacagcgtgtctcccatgagttttgcattaagctacacagtgcttgcacggtgcgggcttcttacttgtcccgggaagtgtgtagtcgaagtgcatcatggccaaattctttgccattctacctacatcctctgtttcgcccccaagctgcgcctgaggtacccctttgcgtcacttgatcccctcggctagcatcaacccccaccgaggactaggatgagcaggcagactttggaggggaagaatgtatgattgtagactagtaggtagtaagcaggcagccttctgggcggtttgtggaaacaagacgtaggcatacatcgggcgaggaagggagtccgtacgtgcgttgccttttcccacgaccactactatgatgattgctgcatggcatccacacccatgacgcaaccacgtgacgggctgggaaccgtgacttgggcgccttttacctggacgactcgtcgcccgacaagccttcccctccgaaggactgcctgcccgcgactctctcgctctgctctctctctctctctctctctctcttcctctctctttccctctctctttctcttttcatattactgtgctttgccggcgctttctgctcgctctctttgcaaaatctccctctctactttagttctgggacctgagtgggcttccctggtcgacacggcctttcccaatcacaaccagctcaagccagcagcccacctctcccttcccacgccgcccccctcaaagggttggtttcctatcgtctgccgtccctcctctccctagacgcagagagcaaggaattaaaaaaaaaaaaaaaaaaagacatatttttttcatctttagccaagtaatatttttttttttctctcttatttttaaaaaaagttttttttttttccaggaacaaaaacttccgagggagaggggagagccaaagaggaaaatactaaaacgggaactccaaccagggaagaaaaaaagggaaaaaaaaaaaggaaatttccatcagcaaagcaaagcagcaacatcgtcgtcgctgtcgttatcgtcaagcccaggactcttctctccttaatcctatcccagatctcgttcacgccggttgtcacgatctcaacgactccatccatgctctgaggtctgcttgtttcgtctcgtccacccaacgtatgttctaattccgaagttctttccttacttttcgaaccccaatccactcactcactcacccctcccctcctcactctttccctcttcccttccttctgtctctctccctctctttccctcacactcgttcccttagacgaccctcttactcaactcaccaccaccaccactaccaccactaccaccacttcccaccacgccctactatgcttaggtgcttttccctctacccaccccccgccctcaattttgtttttctctccccttttacacaacaactttgttcttattttctgccataccatctccttttcttctttttcgctctatttccccgttctgtctcttttctatcatattcttgtgttcccgggtgtattcccagttcttcgaactcctgttcatttccattcccttccctcccccctccctattttggcctcgcacacccaccaaccaaccaacccccccccctccctccctccctctcatcttgactaccaccccactctttcccctcttcgcctcaccatcctcccctcccgttgtcgcaaaggaaaacttgagtggaagagagataaaccaacctctccatgagtggaaacgaatattgttgttgactcgtctggaaaaaggcagagcgatgattagcctcagggtggaacagcactcagaatctccgagatcccgtcaagaccatctttcccgtggaaacgacgataccagagcctacgacggcaatgccgattgccagtgagagtaccaccgtcaactccgttactaccacaatgacaactttttccgccccggtcaccgcacctagatcgatgcccaacaatcagtctgcgttggcggcatccttcaccaatttcctcaccgtatcaatacaccagatcctgtttctacgttcggtctatccacgagccacgttcctccccgtgcgggcgtacaactatcccgtccgacaatcccgtcaccccaaggtgtgtgattacatcaatgacgcgtcaattgcggtcggaacggagatcttgaaaggcacaataaccgctgtcagcattatcatctcctccctccgcacgaatcaacccctcgaacgatatgcctttgatttatcgggcttcccccgtgttccggctggcgaagtcaataccaccttcgaagacagaagagaggaacaaaccaaagcgggtgttcccgtaaccgaccgggcttccgcccccacatcagtcgaccttgaagcgcaattccgggcctgtttagcaagactggcttcagcttgtgcgcgcctgactcctttgcctcgggacgatgaattcagtttcaccgtttgcatcgaggtgcgggaagatgctttacccccggcggggaccacaaccgaagaacagacatggattgtggccgaaccggataaggtccacctccgatcgtgcaccgccccttactccgtttctaagttgagaaacggcgagccgcaacagccgcctcccaaggtatcgaatggacgtgccaagacggtcccggtacgacgtgtagaagctggagagcttcgactggaactatgggtggaagaggcacggcagaagtttaatgaaccggtggactctgaacatccaccatgagcttggatctccatcttatagcttgctgccgtgttcgtctagttcaccattattttctgatttcagtgaaacattttctgctccttatctcatatctccatttatctcattcttgttttagcgtgaccaatgatcgaacatacatgatggatgaggaaattaggcactgtcgtccgagtgagcggcgcaaatatataaaatggggagcggacgatttctgggactcgcatggcattacatagatctggttcatatctttccttgtctttttgctcgcaaatttctttccgtccatttctgcctgtcgtcattctgtcacgttccttttccccttctatttctcttctctattactacttatatctctcttcttttctttttcttttttctctctgcacttttccctttttatttacaattttctcatctctggagacgtctatttctttttccaagcatactcctccattctcctccccgccatttcctcggagtgttctcattttcataccatttcctattgtattccgctcgtctcctttgttgagctctctccaactacatgatcctagcaaattcaaatatctagcaactagctgccaaaaagttgccagcatggaccccactgctcggggagggtctcgagtcctgtccgcaatcgttaattttgtccccatcgcatttcagttggcctatccttgtttctctcggcgtgtgtgtttgcctatgttcttccttcgcctcgctttgacttccacgtccctcttgagaacgtgatccagtgaaagagatcttgacaccatttggctgcataaagtcatgatatcagctgataatgggatacaggcgtccacagtgtgtcagtatcactgcgattccatactgcctcacatggaagaaaatccaaagctgagttacggaaaccgacaaacacacgcagccgctatttacagacaatggggtgtctaatacaattggttgtggttgtgcttgttgtgcttgtccatgaggttgtctgatcgattggctatggaaaaaggacgcagatgacctatctgtatggaactttaaaaaaaaaaaaataaaggaagaagaagaatgggttcctaacgcatcatgtgagttattatttttcacctgtatattgtggcatatatgcgtgttggtcatgtgctatgctacctatcctgtgaaagtgggtttttattaaacatggctttcgtggtttcctttgactcgttgtcagcgcttgttgttgggctcagtccccatcttatcgtcgcctacgttgcttttttggtgccgtatttctttttcttttttgcgtcgtcatgactgataagatgtgatgttttttggatatgagatagtgatgagtagtagactaggtcgggcactcggtaggcagataggtaggaagtttcttcttttatctcatctctaaagtaatacttttttcttttggatttcatctttggttcgccttcttcgtttcatgttgccatatcgcctttatcgtccgtttcagcgcgccccagtcacatcatccatctgttcctgcttttcgtagctgtaattctatgtctcttgttttttctggaaaagtcatagttggatatgacgcttgccaacgtatgcgatatcacgtcatactatattacgatggtatacatctaccacattgtaacaagtcccatctctggtcacagttggctcttactccatcggcttctttcttgtactataacccaaggtgtccaggacatgcgatctgtgatctgtcataatctgatttcgttctgaaatcgaattatggattcgtgctggcattctgaaaatagaatagctaggctttattcgatgatgacgacttcaaacaagagagagagagagagagagagagagagagagaagagtaatgagcaagtcattggattattggattgagccaaaaatagaataaattagccattctaagttacctaaaccgagagaaatggtgagctggagatgatagagaaagaggaaatagaggattaaagtaggatggttgaggtaagggactgggagaaagggaaagggctggtggggagaaaatgatgatgatagatgctagggaaaccgctacagtatttcatttattagagtgatggaaccaaaatctgcgatgcaatccaacttccaagaaagctttctatcaataacgggggcactgcttgtttgtcttgtcttcgtgctcggatgaagcaggggtatagatcgctgttgggaagtctggtatgagaaagcatctttgtgtaacgctgaaaagctgattgctgttgttaccgagagtgatgtaggggccagagatacgaggacgggttagacgctggattcgatgtgaaggtagcaagcaggaactgtgttgggggaaaaggaatggagtcggtataccaagatgggagctgcagtatcgacaaatgtcgatccagggtatggtgtatcgctctttctggaatgaaacgaggtgtaaaggcttactggagcagggacatcattattgtcgatcaacgtaacggttggtgcttcataaattcgtgttgatagtgtagtagaggcactagtaccgccatggggggcgggtatctgccctttttgtctgattttggccaggattgccttgatagttcacgcccctgtttacgaagcctccgtacacaggaacgtttgggggcgcaggaccccctggtgggttcctaggttgtcctactgggttcggaggccagtcttgtccaccccagccatttccaatgcctacgggtgcatcaaatcgaacaacagctggggggttggctcttccaactggcatccctggtcttggataccccacgtaattatggtggactggcgcttgcccgtattggtgtatgaatccatgaccataacctggaatgacgcctggcatattcgtggccgactgtgctgcttctgcgtcaggaactcgcagctcctcctcagtcaaactgggattttgtgccaatataacatcgatagtgtctttttgggccttctcgacctcttctaacgataaccttgggtcatcggtgttaggacagtaggtcggaggacgcccaaaatggtcgtacttctctcgggtaatatctttcttgcaaatgtagcacattgaagtacggcacttggagcagatcattttgttgcagcccgattccttgacaatcttcacgttgcatttgggacaagggcggatcagagccttgctcattgcctcttcaaccaagtggcgttcggggatacccttctcttttttggcctctgcgcaagtgcggggaatatggctttcttgctggcaaagacggcaactgaccatttcgcactcggggtttttgcatacgaactcgcggtcctcttccacgggaggatagatggctttatattcacagaatggacaagcttcaaggcctatcaatccagcttgctgaatctcatcctgctgctgaaggttgtcgagctttcccatcaaaccctccccaagggcttcttggagccgcgcacgagaaaactttgcctgacagccactagtgtcgacacattgaacttgatatttcataagcccaacttgggtctctgcagattttcgaatgcatgtaaagcagaagagatggacgctctccccctcacaagggagcgatcggttcgctggcacatcgaggtagcaacactggcattcgatgaggtttccagctcggctgtgttcttcttcatttctgatctcagcctcttgctcctccttcttcttgcgaagtacatctttgcgggtcattagctgatcagcatgggtttctcgtactcagagagagattacttacggtcttctttttcagctttcttcttggcggcccctagttctcgagccaggttctcggcgatagatacctcctcgtcgccttgtggtaggtttgctgctatcgagacccttttgcttttcaactttgtgtactttcccgtctgttcattctcctgagaatgcagagtgagatacgctgagaatagctcttttttgtcggtcagaacatcccgaatatgctttagcggcatccattcaaattcttgagctagcagtccggttctgtaatagaaagttcagcgcttgttacttcataatgatgggcggtgcactcacgctagctggaggtatgcacggctaccacgttgtgggatatttcgcagataccgtatcgtagcttcctcctccgtctcctcaatcttacgtttcttgaccttttcttgcatggggtagttaggatgctgtaagatatcttcaataacgctttccttcaatgcattcaggggcagcgcaggctggtgcgcttggggccttttatgacgttcgatcagctcttccacatgctgacgactgatgcccggaaagatgtctgtaatctgccacaatagctcatcctccagggtgaggtcaatgtaaactgcttcagagtgcgtattggagcgtgacgaggtcgatgtggtcgcaatggtcgatgggcgcgaggagctccctgactcgatccctgactcgtgacgacttttaccatcagtatcactgtccagaatgctgattatggactcgtgattgctgctgcgtttgctgctgcgactgctgtcgcgactatactgcctttgtctcttcatgggttggtcgtagtcaggcaacggatagtaaccgtggccgtacagatcccaaatcagcgcagggttgtcatccagagtaagatctgcatttgcatggttcatatatcccagtcttaaagggagcgatggatacatcggattggtgaaattgggcccctccattgttcttgtttgctttgagcgaaagaaaaaaaaaaaagcgatgtattcctacgtttgagagtatctgaaagggaagtccaggtgaatgaaagtatcaaggttgataagaaagccaaaagggaattaagggtcgcttattagctgtgatggttatataggaagggggaaatggtggtgaaaatgttgaacgtagcgttgcctggaaaggtagaccccgcaatagtcagtgaggaacgtcggcaacggccgtaaatcgctcgaggcagtgaaagtaatgtgatgaggctatctatgttatatcagtctgcagggcgtgcggctgtatgtagagcaataagcatacagccaaggcgagcttagtttattgtctttgtacacctgacaagcatgaatgggatgatacacaaaggctgtcagtgaacatactcgagtgaggatcaggctcgtcagaggccaccacccaagcaaggctgaagccagcccacaacctctgggtgctcgcaaggctctatcctgccaccggatggctaaatttgtatagaaaatgttggtggatggagagatattgtttagcggttgatcatccgaataccagctcgcccaacggggaatagtatcaacaaggcccaaggttggcacacacagtggggcggaagtccgtcaacaatgctggggaaaatcctatctacaacaggggaatagctccgttgtaagccgtagactaagacactgatcaggcaagtagacggaggaggcgttccaatgcgtgacgctagacggagaaataagaaagcagccgccgtctagacggagcagcagtcatttgcgagagtctgaacggggatttcctcgagtgggagatggttggggggatccagaaaacgaacccccgccggctctgacagctgccccacgtgacaggtaccggcattaccccgaccgcctgccaagtagaggaactgtctttgtctgtttgcctacgaagagggaacgtcaaacaatgactcatcatgggcgttcagaattgaaagttaatttcaagttccggatggattgatcatttctagacaactcgattcacaaaacaaatcggtagtcaagtatatctcacgacgtcaattcaatagcccccggtagtccccgaaccccagaccaatccacccaacccccatatccggcgagccctatgccctaacgtcgtgtgtggtcatcatgcgccgctcgacgtcacggggcatgagacgcaacccaatccaggcaagtccatccctcagcttcttttaccgctgcgcttgtcgccgcttgtcgtcggctgtcggagcgaatagaatcagctgcctgcgcgcccagtaagttatcccggtcacgtctactttcttatccttatcagtccatctataatattcggcgccccccttgcggtcttgagcggactccggtcgaacaccttcggagttgctcctttgctccaaacatctgctctcaaaacgcgccgtgtagtccattcaccatttctcgctcacttgaatctctttcaccccctcatatccaagtttcaccatcaggcaacaagaagaacagctctgttctaccaagtagacatcatgatcgctgctgacaactcctatttcaacggcaagaagctccctcaaggggattctcctgaattggtactggttcctgccacccccggagagcggattgagtccatccgcctcaacagcaaagcatggaagggtcgtctggaccttgagacctatatcatgcgcgagaaccatctgtatcagcaacggctgaataaggatggcttgacctgttggatcttggttgatcgcaacgagccggaagagcatagaacgatcctcggttcttgcgagacatacagaaagaaagccatgttggcacatgacggtactgtggaggatgtcttaactcatggcattggaagtgtctattgccggccggacttcagaggcaaaggatacgccaagagaatgatgcaggagctgagcaagaagatcgagacctggaagatggagacagaaacccgaaagtgttgtcttttcaccgttctcttttcggatatcggaaaggacttttatgcccaatttggttggcagccatacatgtcatgccattttgccttgccgccagtttctgaggaagactatgcctctgccaatgcccaggccaacttccctaaaacaaggattttggcagcggaggacgtccacgagagcatctgtagtgaggaagttttgcaaaaagagcgtgaactgttgagagcagtctcccaaaagtcgtcagtgcccaggattgcgattgcgccaaacttcgagcactttgaatggcactgggcgagagaagaattctatgccgagagaattcattccgaccgagaattgcctcgcgtaaagggtgccggagaagacagcgctggggtgtactgtgcctggaacaggagctttggtgaaacgcccgaggaaaataccctttacatcctccggtgggtgtacgacgagccaacctcaccagaacaggacgagaagatcgtgaaagccatggcggcggtcctgcgacgtgctcagctcgaagcgcacagatggaacatggcaacagttgagttctggaacccaacgccgctgttgagaaaagcagttgccttgctggaccccaaggccgaggtagtccatcgggaaaagagcagcattgcgtgcctgagatggactggcgccgaccacggcttgggtgcaaacgtggaatggcacttgaacgagaagtacgcctggtgctgaggaagacctgcccccctgataaagttcataatgcctctaaaattagagcctcaacgcttctgtcgcttctgtcgcttctgggttttgaataattcatgccagtttcttgtctttttcgcagcggtagacgcactagcatctgttgagagatttttcttcagtctctgccgatcttcatcactgacaaagcagacagtcgttggatcagggaatctatgtttatcctcctgtactcactgttagagtaaagcaagaaagacgaataaaggaagactcctaccgtaagctgcgagaacgtagcttcctccctccagccttctggcagatgatccttccaagcgttgagaaattcgctacgcccagcagcagcacccgccgtaggcgccacagcctctaaataggtttcgccaacccatcgcacgcaccgctccttatcaatactggcccctgcaccaacagataaaagagtcagctccggccagtcaaatccacgccttctgggatacaggaaacttacacttcaactccccctccaacaacgacccttcatcaccagtctcacaaaccctccttacaaccgcctcaaacaactccctcggccactccccttctccatcctcatcaagtatcgacttccacagatcccttaccaagaattgcgtccccagatcaatcccctgcaacacagccccctccaccatccgtttccacaccccaatcttggccctcgccgtcgggacccacccacgacccgtagcaggtaacacaaacgcacaaatatccttccaggccctcgcacattgcagattcgacactggaacatcagcaaatagcttctcaacaatctgtctctggtccgtagactgcaccaccctccctccctgcttcgtagacatggagacatcatcagccgagtcgtatttccccaataacccctcgagaatcgggattatattgagcccttcctgcggattgtatagttcaagcgtggacccgcacttcgcgatcgcagtcattgtctccgagaggttcacgtcggggacggtctcgtcgttttcttgtgtggcgccgatgacggcgaggtcgccgcgctgggtgccatcgtcgcttgggcggaggatatggagtgagttggaggactggacttggcgaatgcggtaggtttgggttggggtgcagaggttgatgtattcgcgggtggtgtcggtgggagcgtcggttgtgtcggtggtgggtgtgggagatttgatttcaagcctgttgagttagatttgttagttcaacactccttttattgggtggcattggattgctgtacgtacgttggaggattgtctgaagcaagaagttctgcgagatccggtggcagttcgagtaatcggaaggcttgttgcggggccgtgtgggtgaagaggatgctttgggcggattgtgtggacatctttgacttcaatgtgatttcggggtagaaaagaagggcgtgtggaagggttgcagtcgctttgattatgttcccttcccaacgattgtagatgtgcagaggaacattccgcgtgggctcttgacgcggtacgcgtgcttttcgagatcgataaatgcacgggccaccgcttaatttgcaaacggaacttgccatgcgcctggtgtgggaatcacaatgtgaaactacaacctgaatattcagttacgaaaggcattgggttgaatagctgttctttcatttaatgcagtaattcattggtctatgctgtacataattaaaagctatcatctcagccataacagagatcaacaagtttattttcttgtgtgatcagacaatcaagtagaagcaaaggaaagccataagcaaatttagtccccaacaccatttacacagtacaggagcccatccagaaacagtagttccagtcaaagaagtcgccctgtggccagcacagcgctgcagggtcagtctataatggggttttcagcgccgttgtttgaggaaaacctcagtgacccaatccttgtggcccgtttcgactgtcactggatctcgacactccaagcattgctgctctattgcttcgcctgttttctttcatttgtaggctcttcctgctctttcgcagcgggctgggccacgggaccttcttcgctgcctttcgtactatcgacatccgatgatgacgacgagtagtcgctcgcctggctcttcccttccttatcaatggcgtcttggaggtttgcactatcgacatcccactgcgacttggcgtccttgaacagcgattgaacccgctcagcacgctcggcctgttcttgttcttccctctcacgttccagtcgctcctgctccatctcctccatatgttggaggtcatccacgctcggctcataaagatgccagatcgtgtagtgcggaaggccaatgacggaaaatcccatccgtctcgccatctgtctcgagttagcatattgcatgtggaatcgccatcgtaaaatcctacctttccgaatccttcggtctcggcatgcttctcaaaactgaaggccgggaaatggactccggcccggaagacacgggccttcgccagaatactgacgcctcctacgccgtcaagctccatttccatatcaggatccccgtatgggtcacgcagataggcgaggtgaggcctccacgttgcatactcagcataaccttccacaatgaccgcatcctcgtccagagtttcggcaagggccagtgcggtttctgactcctgccaggagttcagatcgtacggttgttccccacctagccaatctggcagggggcgccaaacatctagcacaaatattagaatagaaatcgcgtaagtcgcgggtaaatactcactcggaacgataacatccttgtcgtgtctcataaggtcctccagaatagttgtgggggccgtcaagacgtccgcatctctccagtaaacccagctatgcgtcggacgcagagtggcgctaagcaaccagttccgtgcctgagccatcagctttctgcgacttgcctgggcggcgaatccgtgtctactctccacatcttgttggacctgttgaccaaaatccttctggataaccgaaatctctccgaacgacatcttcggatcggcgtcgttctgcaggtcatccagcatcgatgacaacatttccatcgtattatcttcggaatccgaaaccaagaacgccaggtctatcaggttatgagggtacgtaaggttgcgaagatgcgaaaagaacattggcaggtgagacgcagcgtctctcaagggtgtgcacatgagtacccgttctccatgctcccaaccactgccactgccctgcatttttgacaagtcatagtatcggactgtttctaattgtaaatcttcggcggaggaaacaaggccaagcgagactgcggggaggaataacgctcgaaatgaagggaaaatgaggatcaacagcagcgttgaaatggcggcaataaggcagagtcgttgaaggagctgtcttcgacgtcgcaaagccggttgtgggcgcggttgaaagctagcaaaccaatgtcagtccaaacgatcctcttgcactgctagtttgatgactgatatgtcaggccaccgattgacctccagcgaggtctaatccatgtgaaggtggtgatgatatgcgatgatcttcgacagttgcaggggccgcttaccggtggggggaaattgaaaaggtgttgttgtgactggctttgccgcgggggtaggcagcatagccattcgagaaggcgtgatgccggttcatctctcctacaattgcatgtagctaggaaacaggtcctgaagcaaagaacctccggggctcctagatcccggagcgatgaccaccagcttcaagaatccctggaatgcgcttacggggggtagaaaacaacaccgacgcgggcacagacgatgaagaatgttagcggatcgcagatccaggagattaataaaaaggtaccgaaaaggcttcaaggggccgaacgagcgtgagaattgaacaacgaggtctgacggtagcattgattgcgtcgaccgaacgtaggctcaaggcggcgtcgagcaagaggtgccaagcatagcccgccttccgggtccagaaccgaatccggcatcaggccttctccgtttgcagccatgcaacctccttctggctcgtctctctcctctcttactccacgtttttctcggttccattatcttttgatcaactgcggtggttgtccatcttgattggcggctcatcgctcctgtacagttcattttctaaatacagcaatagtggctttttatgacccaaagaaaaatcaactccttatctgcaaacccaggttcaaccgatagttcaaagtaacgccccagaaatgctcctaattttgggatggtgtaccgcgcaaaagacacagaacagaacagaaagagatgatgtcagaaatgcttgtagaatcccccactaacgagcagtcagccgcgatactcttgattgaggcgatcccatgcctttgacgcctatctcgatctgtcgcataaccttctgcagcagcccatccatgcgcggcacatcccgcaaggccggaatgacggatgcggcctcgtattcgctatccaagatataatatcgttcccttccccagttctccaccgtctccttttgaaatgcgactcttgcaatgaccttggctggaacgctagccttgtttatcgtactcttggaaaacacccgcaggaatggccggagtccagaccgcgtctggtgtgccattcggaccgataacggggcatcggtcgttaggtggctctctccggtcataccgccgggatccattgtgtatacattgagcgagatgttgcccgtctacccccattcggcttttgttagtggggtactttgggacagaggggaccgtaggggaggacaactcacaagtaccagacttcgacgcaaggcatacatagcagcgctcattaacaacttactacttccgaagcgactggtcgcttccttggcgccaattggtgttcctggcggctgggcagcgctctccgggtcttcgctgtcaaaatagtccagggatcccttggacatggaggagcacccgatattgattactcgagcaccaccgttcggtgtaccgtcgcctgcgcggaaggcctcgagcaggctcacagtcaacaggaacggcgcgatgcagttggtctggtagacgggatcgtacccatctcgtgtgacttgatcggtaacgtatgacgaagttgcggcggagttgatcaacaagatcacgggagggatctctttacttcgtaccctctcgacggtgtattgggaaaagctcacgacggagttaaagcaggcaaggtctgctttaaccacctcgacggagcggggtccgatgagacggatcctgtccgtcacatccttgacgctgtcggatctgatatcgcgggccaccagcagtaagtgaacaaacggctgtgctttagcaatcgagacagctatctccgacccgagcaatccattcgccccggtgataatagcggtaccaacaagtggagttcccatgacgaaggttggccagcacaaccaacaactccaagaatagatgccaacggtaagggggtagtagataagtaggtgacaataataataacaatgtcagcgtagagccgaactcagcgcaacaacatgcttggggcgcaaaaaaaggttcgagagaacaagaacaagggaaacccaaaatcgcaaacgacaggcgacagggtcccagaagtttaagaatcacggaatcagacagacagacagacaagtcggacagttattttccctctaagcgatcagcaaacagggttcattagataaatcccgatcagagcatgatggggcactcttcggaagtcagtctccagcaaggtaggtcaagggaccaccgacagcctctcgcctcgatttacagtagcagaagtattggcagtagcacagcgaagattataataataatcagaataaaataaatatcccaggagtaaccaattgcagcggctgccgaccatcagcaagcacaaaggggcaaaataataaaaaaaaattagaaattgagaaagaaaaaaaaggctatacgagtaagaggcgcagaaaaaaaaaatttagttgcttgcactcgatccccgtcccgaaccaaggaaatcgaaaagatcgaggcgccggcagccgaagggcaaatcgggggtggtttagtttagtttagtttagtgtagatgggatggataataattagtttcaacgccagagccagaatcaggcacacgcggataagagatgctgcgaaaaaaaaggaagcgacaagaaccaaccaaaccagaagtttgaaaccgtgggtgggggggaggtaaccaactaaggtagaaaagtactaatctaggactgttctccgtagtaccattgaaagtcaggatggatggggggatccacacacttcttcgggttgtgagaaccaagaaggaaaaggagatggatggagcttgaacgatggatacttactactagttagctggtcaggtagtagtcttaggttaatggatacttatgtggttattaatagatggagggagtctgggtatggcgtcagttaggtaccggtcagttaatggattattttatgactctaaagggaagatgaaacagaggcaggtactcattactacttgctacttgggaatcagatcaggccatactactaataatcatcataatcctgatcatcatcacacattattactgacaaacgaactgtaacaattgtgagttaaaatttgccaggattctccagtccttacacttctctgttccttaaattagcaaaagttgtaatgaaaggcaaaaggcaggtcagcgtaagtggaggcgagacatgcataagacgacggcagccactgttacgcccctttatgcaggtagaaaactggttccaatttcatactcttcttcgcgttactactacttgaagagagagaatactttctagactcatcatcttagaatttgagtaaccaattcaccagtgctcaagtcagctaacgaactggactaactaaacaatgaataatcaatagattattctccgatacaacatactgcgtaccacctcttctactaatgtacttcagtatgatgggtgacgttatcatggccaacccggctatcctattaacagcaacatcaatattgaacaagcacggttgggattcaaatggaattaaaatctctcgaaaataagaataaaacaagatttaccatttatttcagattccataagtactgacttcgttaagcccgtctgtgcatccagactgatcgtagaccactaactagcctactaggtatggagtacttatttgatactatctcgtaaccactttgcaccatttgacgcgatttatgataccaccgactactataccctggagagcacagcaacagcaacttaccccaaagtggcgcgatcgaacgcatgttccttctgcagactagtattcacactaagctaaattaagtagaagtatggaccggggtgtgcttattgtgcttgtgtctgtgtttgaatggggaccgagagggaaggacacaaaaagggtaagcaaggatgaaggctttaggtgcgcgtgatggatattagatagatgaggatgagttgcgttatctccgaggtgaatggtggggagatctcggaggtaactaggttgatactactacgtcgtagtagcttaatatattgaaggtggaagattggagaggggagatggatattacttaattgtacgatatgctgtgtgtctgtgtagggggtaatgttggtggcgatgaggtctagactacagtcagtttctaggaagtgaaactctcttttttcccttcaattgccgaaaacccgatcactgtaactaactacacactaagcttaccggacaatgggatatctgacacctcgattcgactaactatccttcgcggatagcactaactgacatggccagcctccccaagtgtccagaacgaactggcgtcggggtccacgatccccgctgaatcaggcgaggtggattcatccaactaattgactagttaactaactagttggcatctgacggactggttcgcccgctgaatgctgctgctgcatcgaactacttggggatggatgaggttatacgagaaatcgaccccgccccagcagagtcgcgcgggaatagcactgcttggcaccaccaccactaccacttaccgttccgaaagactggacagcttgctgtcgtggttacactcaccatccctgctcagtctctcgtattcattccacacgtgttggacgttgaaggtacagtcctcccacccccgcctcgcctcctcttcaaggaatttcctcctttccatggatatcgagagacaacactgcagggaacatttctacatcacgcacatagctagcgccgtattcccctcccctggcggaccagtctacgacacggagtccccggatcaagaaatgccttggcattgctgacacgtctgcctctgctggtctgggcattgcccgggcaaagcaaagaaaactggctacgctgcgccttcaagtacgccaatcccgggcagaagtaacaagggcatggtatggatgttgtcatgtataacatgggctaaaatgcaagtaacaacacacgtatctgaatttggaccatgttgtgctacacaccgccagccgcagctgatcaatattcgtcccactcgctctcgatgtctcggactttcatgcagaaatgtccaccaagatcttgatttggttgtctcggccgtggattaacgttttgaagcctttttctacgatgtcctccatgcggattttactggtgattaaggcccgagggttgagtttgcctgtgttcagtcagtttcggtataacgtgtggatatagttaagcatggctggcatgtgtaggtcatggttctggcagtcacgtacctgaccacatagcttcgatgacggcctcaaattctccgtcttcatatatcaccgaccctaccacgtgcttttcgcctagtaccacgtcaaatgcatcgattgccggcttctcactccagagagataaaatcgtcattgtgccccgtgctcgaatccccttcaaagcggtgtctaaacctgcttgcactgcagagcattcaaatgctatatcagctccggcattgcccgtcatcgcacgcaccgtgcccacaacatcggccgtccgggggtcaagaacccgcgtagcgcccaaagagctagcaagttccctccgctgcgacgagacctccacgacgacaacggactcaatgccgcgggccttaagaaccagaagtacagcaagcccaataggcccggcacccaccaccagtgccgtacgcgcatgatcattttgaatagaagaccgattgactgcatgccatgccacagtcaacggctccacgagtgctacacaattagcaccacatcaataccccaatcaacattcaatagtaaaagatagtcaactcacctccaagatccaaatcaaacccctccggcaaccttacagccctatcctccttgacaacaacataatctgataatccaccagcactacctgttgtacagtcagccaaactctcaaatagacaccaccaccaaccaaaacaaaagtaagaaagaagagagagagagataccactaaaccccacaaaccccaaattatcacaacaattcacccaaccccccagacaagccgcacaccctccatcgaacagattcggcttaatagccacattatcaccaacctggagacgagtcacaccctcccctacttctataatcgtgccgctgaactcgtggcctagtgtcacggggatcttttcccccgttatggggtgcgttgtgctcgggatggtggacgggccgtggaggtattcgtggatgtctaattgttccatcagcgtggactggactttttgctcatagtacatattgtataatgtgtattagttttaggtggggaagaacatcgtaccactaccgcatatacccacgaaagcaggccgaatctatcatagcatattagtactatatcctaccagtaagaaagatagtatagtagataagataatagaagatcatgcaaggaccgccataataacagggtatcatagtatagagatataatattatcggaatatagaaccaagaaactgctatgaaatgaacaagataggaagagacgaaccttcacctcacccaccccgcacgacccgggttcctggatctcctcgacgcggatatcgcctcggccgtggtatcggactgctctcatggtgagatggagtatcctttatatggcaatgtatgttactttgttgggggggggatttctgtggatgtggctatatgtatgatactatgattgggaattttcaggggaaaagatgaacaagaaaggattctgaaagtgggtttatgtgattatgttccgatagcgggagatttccgcgaagttggttacgttctcggatgattatacttggcaatcatagtggtgaggggtagattaattcaaggtgaggagaaatttagggtatagagatgtgtggattaatatcgatatatcattcccatttctcgtctaactcgcaatggcgctatcaatcataactgactatttacgtttttgattagagcagccctcttttttcttttcttcctattgaaactgccttttgtatctctccccaattcaattaatcccttaccggacagccgctcccttcaggctcttgactgtgcaaagtccaccggactgcgtcttcaacttacccagagcgggcttgccctcctggccctgcacggccggaacggcagacatctcaaaggcgacctcgaggtcatcggtggtggtgaaaccaggctggtaggtctcccagaccttcttcttagggttgagcaccttctcgggctcaccctcggtccagccctcgaagcacacgcgctcaccggcaggggcatcggcaggaggcgaaacgagctcgacgggtccagcgtgcgagtcctcgccctcagccacgcggggagaggcagccaaaaccatggcgcaggacttgatgccacgcatggtgacgggcttcaggttgcagacggcgacaatcttgcggttctgcatctcctccaggggaatcagaccgttcaggccggagcacaccgtgcggacggtcttgcctgtggcctcatccagagaggtgttctcggtgcccggggcgtcaccgcagtcgatggtcgagacgtagagggagtcggcgttggggtggttgacggcacgaagaatgtgaccaacacggaggtcaatgacggagggagacgggggagcagcaggggcgggcgcagccttggccggcttctccttcttttccttcttctccttcttctccttcttgggcttgccctcgggcttagcagcggcggcggcgtcacccttagcaccgtcggccttggccgcagcctcgggcttgccctgaccgacaacgaggggcttgccagcagcctcgggcttctgggcagcggccttctccttcttcttgcgctccttctcctccttggggtcgacgggcttgggcacgaagcgaacgtcgttcacgtcaatggtgaccttctcctcgtcggggatctgtagagcgaaaatgcggctgttctggacgaagtcgacgtgacggacgatgtggtggtagccctgctcgccggtacgctcctcgggggtccatttctcgacgagaggagcgacgagagcgtagacggcaatatcagccacggagggcttcgcaccgagcagggttgtgcgggtggcgaggtgagagttcagctgggagaggatggtcgagacgacgggcttgtcatccttgctgagagcggtctgcagaccggagatggtggccagccattgcttgacgtcggcctcttcggcgacggaaaagctagtctgcggaaagattttgggggtggccgtgtgaaggtcgggctccgtggcgtcgggggagatggcggtagggtaggagcggtagaggagggaaaggagggaggactcgggggcagagttgatggccatttttgcgaatgggcgaccggcaggctggaggaagaggaggagggacgacgaggtggtgaacgagagaggaggggcaggattgaatcctaagcagtcacggtgattcagcggtcgagcgaaccgcggggttcttctgctggcgacccgcagaagagcccccgttggcttgaggagcgtcaccttggtcgctgctcacacaagatccctggctgagagggatcttgtttcctgggttgtttaataggattagattagatggttttgtttacaagtcgagtagtagtgttttttaacgaccaattgaggagcacttggtctcgctgcagtccggcttcattttacggtttatttttccttttcttttcttttttgtccctcctccgtttctgggctgatcgcccaaaaccgtttagggctgttggcttactcagcactgctgaagacggtctttcgatctacgaaatagttatgtacattttctggcgacactcactctctacaccagtctggaagctgattcagcaacttgctctctattctcttgccaatttagcatattaatcttgcttcaatatgtacagtgccgcccgttattgcctttgtcgtgtgacccctaccccttgcacgtgactgccaaagctattaataagcaagatatagtcaatcgaccctttcaaaaatatatgagtaattttgtatttcaagaagtttatccttactcaatttctaaattaagggaggtaaatggggtttcaaacatagaaactccttgtaaaatataagtaacctcgaataataatattttagttataaatatcagtatactttccataaaagaggtttagatatagtaataaagtctgtaatctaactaaaaagctgagctgactgtaagatttaatactagattaacattacttgatgcctaaggccacaagcggccatttactgtgaacgtagttaaacttgctgtctagccgacctgtaaccacgaggaagctagtatagcagtcggtcgaggacaggacaaaagcttgattttcacgactctttaattatttcatcatcttatacccgccctttccaattttccactgcacccaacctacattagaaaggctgagagacaaaaatggattgggatgctttgtggttcaacgttgccacgttaattgcaggggtgtttgtccttgactatggcgcagacaagttcatcgaccacaccgttattgttgggcggcgccttggtatctcgcaaactgttattgccctcttgacagctggcgctgaatgggaagaggtgttttgcaattcagtgcaatccgatccaatgtctatcctggctaatctcttcactagctcgctgtggtgattgccgccatcctgcagcatcgcagccccctagcccttgggaacgtcatgggctcgactatctccaacattctcggtgccttttctttgggactactcttctacccccaaggcatggagtttgatcgcagcgcaaagttatactcggcgctgctgttcatggttaccacgctcttcgtggtgttagcattcttcaaccaattgaaccagatcgtcggcggggttttgattgccatatttggtctctacatcgtctctatcatctacgccatctataaaggtgtagcatcgcccccggagctatcagacagtgatagtgacggggaatccagcgatagcgaggacggggacggggaatccatcaatcatgcacctgtctccgagacatcgcctctcattgagaatgagcctgcgccttcatcagctgacaaagaaagcagacgaagcagaagcctcccctatcacatattccagctcattctcggattcatctcgctctcaatgtcaggatatatcctctcccacagcgccgtcaccatcgccgactccctgcacctctcgggatctgtcttcggtctgaccgttgtctcgttcgccaccactcttccagagaagctggttgcaatcattagtggctcccgcggccacggcggcattatggctgcgacgactgcaggaagcaacattttcttgctgacgctctgtgttggtgtcgttgcagtggcggggtaccaggtacaagaggcagataattttgtgctttttgagctggtggccgtgtgggtgtcctctggggcattttgtgctgttatctttttgggactggggaggagtgcaggtgtagttctcttagttgcctacctcgtgttcctttgcctggagtttaccgtttaccggcgctgattagccgttagactttcggggtgctactatatctatcttcgtatattcttcggcaccttttaaacaacgtatgaagatgagacctacgttggtttcattagatataaacatggcgccttgatacaccaccataatatggactcgaagtatatacttgtatcatggattagggttagaaagagtgtctatgtttttcgatgtggaaggcaataacggtcggcactgtaacttgaattgtagatacagccacgcactcctgccttgactcacagacccaaggtaaagcaatgcacgtgagcaaactatccatccatcttgcccacgtaggagacagtccaaaaaatcagacgatattattacacgcgggggaaaagtacaggaaaaggaaactagttcttgggagaggcaacaccaagcgaggggccgcgcatgtcgaagacaacgaaaaaggccttcaggaaaatatcgcccagaatctgcagcgaggtgtttccgttggattgaatgccgccaaagcacactaaccagcacaatcagtcaatcatgttcaatcatgcaaaagaaggggagcaacttacaggcctgtccggtggtggtgttggtgccaaccttggagaaattgatcaggttaccggggatcgtggccaggctcgactcgccgaggacaagcgagaagctgggaagagtggtgttgcaggggtagatgtaaccaccggcactgctcacgtagaccgagttgggaacttgcgcatagtaggcagtaaccacgtcttcatccagcagcataagggaggtaccggtgtccgcgatcgaggtgttcaagcttccaatgtccttcagctctccgtctgccacggagtacttgggagtggagaactgccagtatccgttcgatgagtccacgctgatgttggcaatgttgccctggtacttgtctttgtcgatcgtgccgaactcgtactcgcccactccgtcagccttgagcgaggcggtcatgacgggctcgtccagacttggtgcgacattggcgaagaacgtgtcttgcgcctccggtttgatggtgttgatggaggaaaagcccaacccgaccaggccgttggagttcgtgtcctcgatgaacgactgggatacctggtcggggacaccgaaggcttgctccttgacaatggcgccgccaatgttgacggtatccgttccgacggggccagaggcgtacgagtcgtcaccatacgagacatcgaaggtgtatccgtccatcttcttgaaggtcgaggagttcgaagggttgtactccgtgtgtcccgtcaaggtttcattgagattcgtatcgaacacccaactgtagatcgacgttaatcactgtaccaaagagtaaacagctgcatccaagacttacaagtcagaagaaccagtgtcaaatgtcatgacgatcttctggccgccaataagaacaggcgaaacgaactcggcatcgttctcgacggaagtagcactgacagcgccagtctgatcaggctctgcaatctcgctcccagcagcagcatgggttgtcgtaatgggtttaaagtctgccagatcgatgttgaaactgctgggagctattccgtacttccggtatgctttgcggagagcagcgggcccatgcagagcaccggttccacgacggacccgttcaaccttgaaggaacgtgctttgtgctggtttgacgggccatggggtaaggagaggacgccgtagctgaagcaaacggcaacaatgagggactggaggagctgcatggtggctcactctggatatgatgtcgacaggcggactataaaaaagaggggatagggcccggcaagtttcagaaacaaaacaatttgaaaacaaagaacgtattaagtagtctgagaattgagaaatagaatcctttccagaaggattgagttttataaaaaaaggggaagcagtatgggggccaaagtcctgacttagcctggtatactgatgttacgaggctgagtgaaccaactggcggagcaacgaacagaccaagagagagaaagaagtagcgctcagcccaacaaagcccggcagatgagaaagaaagtgacagcgggaacgagaaatgaaagaacactaaggttaacaaactagaagagaaatgtaaacaaaaaggggaaagaagtgcagtctataaaagggcagcaagtcgaaaaggaaaaagttcggcgaggcattattcaccgtcgagcgacttttagcaggcctactatagttgattcgcccaagacaccaagactttcgcactctacatcgatccacccagcacggaggctggaggggtggcattgttccaactagctggaccagtctggtcccaaaagcccagcggtggaatcatcaaccaatcctggatgatccaggcccagttagcctggactcacgggagaaacccaggggaaacccatcttcatttgcctgacaccggcggggatgggaggggagggggaagagaagaaagtgggttcaagttcaaccttggatcttccgcttgtgctgctgcagaaaactctatattttcttctgttcacagcagcagcagtagtagagagcgcatgggacatgagtaacctgcctttgacagggcgactggccttttaccttgacagcgaccggggcgagcgagtccctgagtggctccttatgaaacagcctaaccgccagggccaggggtcaccggccaatcaccacaggaatatcatgaaacaccagcgtgcctcgaaagcggttccgtggataaacttcgagttaggcgtgttacaaagtccagcctgggacgccggctttcccccccaccctctggccctgccattgagccactcggcattaatattcaggcagcagcagcaacaacaacaacagtgcacaaggtacgctgcatcggcatggctccagtccacataagcatccgaatcccgagtacgtcaatggacgagtcctgcatgcgtggctaaacatttcgcaatcgtgcacacgtacacaatagatcgatctgaacaaacaggactcttactcagccctggaaagccgcgtacgtaggcagtcgagttttttgggtagtgttcatcattgcccaaaggaaacctcaagaattggacgaatagatgtccgtcaacacagttgggtgatagactttttgtttgcccagcgtttagtttcttggttaacccgttaactgcatgacactgactactccgtactatctatctaatcggctactccgggggaaaggttgatcttcaacccgtctaggtagtagcagcaataatcccacatgtttagaaatgctacttatctttctcggcagcatcaaaagcaccccccaagacccaatcagtaatcagtattcgttgtggctcgcgggacaagaccaagcaagcagcagcaccctgaatttgttcaacctcgggccacccccgttgcggatcttcatcagcggatttccgtctccctcaaacagagccaagcaaacggtgagatgaaaatggtccgatggatggcccggcggggattcaacttgcaatctgccaagtacatttcaggccctttctttccacttggcgggcggtccggcactttttcttgtcgccaagctgtctaggaagtaaaatacgactgatgaagtgggtagtaacttcattatcatgttacatagtacacttcatgttgtatctcgatgctatctataggatcgacagcagcaactccttcgctttagtctagggcttagtgagcactaataacgtaagtcggtagttggttattaactgctatttatttggagtaaacacgcgaactactcctactaccatccgtgaacacgggttctttctcccccgcgcagcccccaagctaggtgtatctcgcccccaatggtgtaagcgaagactacgaagagtgccttggggtacaaaaatagtaggaaaaaggagaagcctttagaaaaaggttgagcgggaaacagagaaagattttgaagatttggtatctaaatgacttcttggtcgaaaatgcccggaacacccacgaattgaaagaaacctcggcttgctatcccaatgctgaacgcccgtgaaatcagatcaaacatcatatatatgagataaacatcactctgccgcatcctccggcagcacgtcgttgggatcctctccaatcatcccagcaaccgagcggacaacttgcttgatcgcaatcgatgctgggctgtcgggataatgatccacgaagctctcaccatagtcacatgccatgcctacccgcgggtcaagaggcacagcgcccaggaaaggaatgcccatcttcttggcgagtcgctttccgcccccggtggtagcccggaagatctgggtctcagtgttgcacgattggcacacgaagccagacatgttctcgactagccccaggatgcgaatgcctgccttgcggcaaaagtctatttccttcctgacgtcgagcaacgagacctcctgtggggtagtgacaactactgcgccatctacaccggactccttgagcagagagttgacggacagatgctcgtccgatgtccccgggggtgtatcaatgaccaagtaatccatctcgccccaatccacatccttcaagaattgtttaatgagtccgttcttcttcggccctctccagatcaccgcatcatcccgattgggcagcatgaattgcacgctcatcgtggctaaattatccgtaacccacaccggactccagcctgcattgctcacgtggatggtctccgcctcgacgcccatcattttcggtatcgacggcccgcagatatcggtatccattacacccacagtcgattcaggatttgcggcgaatgcgtgggagagaagggaggtgaaagtagattttccgacaccgcctttgccagagagtacaaggattttgtgtcgtatttgcgatagccgttcggtgatgatggggatatcggggtcaggacctttgggggcagatgcgcagatcgattgattgggacaccctgcacaggcatcgcctttgcctgcttgttcggactcgggaccaggacaatgttcttctcagagattagtacactaatcatatcctaagcagatatcccggcttcatatcggacatacctggctcaggagccaccagattcggggccatcttcgaccgcgcctcaaggtaggcagcggtcggctcctccagagaaggtgccatctggattttcagtcagttatgtacggtctcttttgctattggcgagaacacggcagatgctgaacattcaaccacccaaaagatgtcgttatgtatgataaaagctgaatgctgtcttacgagaaaagtggcggcgtgaccgcgggcgggatgcttgataagcaacacatgacaaacgctgcagtggcgattggcgcggggttcgtttcggtcgcagcggtgtcggagagagcggcgataagatccattgctacccatgccaggaacaaatttcaaagcaaacaagctctgcacataatcttagatctaagctgcgtatggaaaatttatcctatcgcattgttaagtagtttaatgcacttttgaaaccaatacagtgattctagtgagcgtggatgctatgaatcctctggactcgaagcaacactctcccatactgctagttcactgacactacctgctaggaagggccattgtatatgcagtagaccataaccctcactcgatgcttgtcgagattgacaaataatgctgtccgtaactactcttcagatacccgacgaatgctgtccccaatgcctctaatattgtagcaagttcgccgattcatagactcggaagggatgccaaccaggcaggccgacacaagaggggcaacctggtctcaatatgttgtcgggaggggtaacgcggaaaattcatgcagtgtcagaactttaacggagtcacacaacgcccacaatctggttgcgcaatgatatcatgttgcccctattagacaaggacaacattctcacgtatgggtcagaacatcctcaaaccccattgcctacatgaagaatgcgtggttgggtaggacagtataagaaaccaccacagtatcctactactaagcgggtaactttctatgcgggtcagaatgtcaccatatgtgcgttgaaataaacacctcgcgtagtcctgtcaatcagtttctatccttggatagtcagaagacggtagtactgcaaaatccttctaagatgaggggaagagatgcgtctctcgtaaagccaatgtcgtttggagtgggttcgttagccatagggagtgctcattgtccgcatgcgcctccaggtacaggtttagttgcatcgaacttggtttcaatcaaggtacacaccatcctggacgtccatgatattctattgatggaaagaaacaattgattcaatatcgaatgggtctgtgatcaatgaacaggcgcagttgccgccagtagaaattcatgtccaatacgagggtgaatgagatggcccggaatgcctggagtgagggaggtgcttcccgaaagccagttcctagggtgtggctgcatcattaacgggccagcagccagcaggtgcagactggaatgatgcggaattccgcatatgttcgtgatcgacgatatcttggttatggaagagaggtttaccctttattccgaactgtgtaccaaggaccagaatctggtagtgcgcagcgatccaatctgcggtgggtaaaagtgggaaggccgtcggaccctggatgttgagatccattacttctgttcaattccagcccattcttcccagaaaagcgtgccgggcgagcgtcatgactggcgtcagttggactgcttgagagtccgggtctttccccaggcagtgcacggggtccacacttgagctgtgctaaccgacaaaagtgggcacttgggggaggagatgtcgctgctgtctcatattgctcgctagtcctcaccccaacgcttttgcagaataaatacgtggacggacctcaggctttcccctttgctggtacactcaaccattagcatttagacttggttgtgtgctgtgtacgcttcacctcttggacaccactcattcccagcgaactcgagggattccccaatgcggcttggtgactcagatttgagcagcacggaccaatcatagttaccctgacgctttaaatacagcctgcccccagcacctctgtcacatgcttttctctcgactgtgcgctttttttcattcctttcccctaaccacttctcgctaaacaattatggatcgaggcctctcaacaggcactcatatcggggatgatgggcttcgcgagaggtttcaggcctctcagtccgattcatccctgggcgctggggcactcactgctgctggtgaggtcgaagccaaggatggtacaagccagaacaagaaaacttttggcaggacccctgatggtacaggtaggcattccattcattgagttatgcgttgaacctggttgatatcagagcctctattatcattcgacaatggcggacttccttctattgttctagtggcggaacttggcggctaatttacttgattgctacatagtgttcacggtgccccaaacccacgacatggtctctcaactcctgtcgccctcggaacctaagaatttgtccgatgtgatagttctggctattctgggagcacacatcctgttgttgtggtggctaccggactttgccaaaattcctgtgtttgcggtcatctacctcttctggcgtgcagcttacaatgccggaataggatggcttttgcataaccagtcccatcacaagacccttgtgcgctgggcggaaaagacaaggatctttgtgaacccgtctactaaccagaatccacaccctaagttgtataacttgctcaagcgggaattggagactaagatccctacagactattcctttgaagaagctccgattgagtacaacacctggcttgtctttagacgcctggtggacttgatcttgatgtgcgacttcacgtcatattgtctctttgctatagcatgtagccaccatcctgtgggtgagagcatgctgatgacagtctcgcgttggtcagccggcattgtgctcgtattgttcaacctttgggttaaactagacgcacaccgcgtggtcaaagactatgcctggtactggggagatttcttctacctcatcgaccaagagttgacgttcgatggtgtcttcgaaatggcccctcaccccatgtattcggtcgggtacgccgggtactacggtatttctttgatggcagccagctacaaagtgctcttcatctccataatcgcccatgcagctcaattcgcctttctggtgtttgtcgaaaacccgcacatcgacaagacgtacaacccccctcctccgcggaagcgtatgactgaacaagactctgtatctacatcatctcaggccactgagccttccgttgcctcagcttcaaccgatgagccactgccccaagcgacaacacccccaagcggcccacctccttcagttcacaatctactgggtttcaacaacttggatctgtatcggataacggatacatcgtcaatcctgatccaactactcgtatttgcactgaccgttttgacgccctcgacgccccgataccaattcctcttcgtggccaatgccgcggtatggagactggtgttttcggtgggcatcggataccttctgaccgagcaatccgactgtaaagcgtggacccgtcattttcttaagtatggcgaaacacctaatgaggcctggaaccagtggaaaggcacttatcatctgagtatgatcatgtgctatgctagtttcattgctgccgtatggaaaatgtacacgctgcccgctgactggggctacggtctggtcttgctccgccatgttctgggcgcagggctcattagcttgcaaatctggacttccgccagcatctacgagtctctcggagagtttggctggttctatggggacttcttcttcgaaggggctcataagttaacgtataacggtatttatcgcttcctgaacaatcccgagcgggtactgggtctggccggcgtctggggcgccgtcttgatcacaagtagtggcgcaattacattcctggcgcttttgagccacattctaagtctggctttcatccaattcgtggagcgtccgcacatgcagaagctgtatggccgaagcctgcgacaggatgcggggctggtcaagagcctgaagcggaccctgccccccactctccgtcagcttcatggaagcgtggacaagatcttcgatgattctttcgagtttatcgaggagcttattgacaccgctcgcccaaagctagctgctggcgtcaatactttcgtcaaggataccacggcgctattccagaagtatcccgcgcgtgtgaccatcacccgcattgatgaggacctcgcgggcttggactcccgggactatgccctggaaatcgaaggcacggattcatcctctctcgaggagtgcgacaagagtactggtagagaaggtgccaatgctcgcgtgcccctcgacagacgaggcgacttgaagaacctggtctttgaatacggttctcccatcaaagtcaaatggaccgctcctctcaaccacagcaagaaggactgggtaagtctgtaccgagtcacggacaacacctcgcgtgaagtctctcgcgtctcctctcaaggaagatgggtcgcaacgaatgagggtttctacgacaacctcacctgcgagaagggcatcataaccagtgacattgtcaccgaaaacagcgagcatcgtgacgtcgccaccggcgaagtcatcttctcaggtgacaagctcttctggacccagggtgtcttcgaattccgttatcaccacaatggcaaacataatgtcatggcgatttctcgacctttcgagatccgtatccggcgcttcgacgaagagtccttcgaagataaccaggcatccgttgaaaagagcctcctccctgttgtccgaaactgcttcgaccgagacccggaaatcgctcccgaaaccgtggaagagcagttcggtagcctcgtggagcgtgacggcaaattcgctaaaagggtcgtctttgctgtacatcagatgtgagttcactacatcctcgttggcgttagtggccgatcatttggatgctaatgtatattctatctaggttcggtattgaattcgctcctgaagttgtccgagctgacgggactgttcggaacctcgcttggagaatctgtaatgcgaagcgggtcttggtaagtatcgtaccttttcttttctttcaaggcgaagggctaataggttatgtttgtaataggctccttatagcatgaccagagatggtgctacaacgcctactgaggcgcatgagaaggacgaggcgtgaggactctccttactaaatggagagtgaatgaatgatgcgtttttgcgactttatctgtttatttgtcccattttctctttcagggatcaactctcgatcggcaggtgtagtacaggagaccagttgtttagttgcatggtgctccagacaaagtcagagatggttctacgaatgataaacaagtgtaaataaaaacttctccatacatatggctattctggtccttcgttgcttttagtttagctttacaaaggctagagttacgggtgtgtatatgcaaaacagaaattggtatcgaaatgggaaatgacattaatattactagctatgataagacggcggacaagacgagattcgaagtctgcaggcagacgagaaagtcagctcacgatccacgagaatgtggttctgagatatagggcatggactccattcaagagaatagagtatatggaaggatcagccaagccgggtaattcatcccatcccctgccagttccgatcccccgtcaagccatccaaaacgaacgacgaggcgggaaaaaggccctgacacaagtcaggcacaacaaacaagccgacgctgacaatgcggacaacaacgatgtagcctgcctctccaggactccacaaccttcctcccttgaacgcctgccgtcctcccgagggaagaagcgagcgtaaggtccagtataagggagatggataagtagatcgttgaagtcatatgcatgacattgttggatgatgcaggcccgaggggcggttctccaaaggagatcattgaatggattgacttgttgtcatcatcgacgtgtggggttgttgtgtttatggttgtagtgatcgaaaattataagcatacctcttctgatagtccaggataatgcagctcggcgcgctaatggcacctatgattttacatacagtaccctagagaattcttgagagctgtcagtaagattcttgactgaaagcaatgagtggagcaagtagtggaagttgtccaattggatcaggagtttttggtaaggtattttgttttcttcaaggtttttgcagaagcagaactgaaaaaattgtttctcatcattggatgatattccagggtagaggcccggaaagattgtgggtaagggaagagtgtggcataccaatcagtttacaacagcgggtttgaggtgaagtagctctagctaatatcctataatcttatagcaatgtcagcaaagctactcaaccaagcatggaagagaaaacacaaggcaattgtaggtgcattatcagatggtgatgcatgtttgttcaaggcccatttgtttgtcgccagaactgaaagatttttggatcttgttcatcaagcaatgatagtagggaagtaaagaagtggaatagactcacgttatactagttagtgacaagttgccaatgaaggcaaatgtgaagtaatttaagtctcaacataaaagacgtgttgcttttcgcaaacaaatcaagcttgtgtggtgcgggagaagaagagaaaggaaaagcgcgagtcgaagcgaagaaaaggaaaagtggacgaggaaaaagaaagcgccgaattccgcgctgcccgccttgcaaaccatgcaaacttccctcaaaattgtagatgaccgcttctggacatcgacagcagctctgcttgaccatccaaatttctgacccaaatccttgtctcgcttcctcaattgcttgtcgcgctggtatgaggatgccaagtcatgtgtaatgactgacagacgaagaatcaatgggccgcctagcggcacgaggccggccgttttcgcctcctctctcaagtccgcttctagcatttctaccggcagaccacgacgtcaaaggcagccggatgagcttcgcaagatctgtaagaataactgcaactcttcttgtatggtaccatggctaatacactctctctccagttctgaagacaggtctcatcccttcggcatctggttcttcctatcttgaattcgaaccctccgcatcacttgctgctgcacgctcaaacccccaatccctgattcctccgtcctctgcattgaagcttgcctgcacagttcatggccctaagcccctgccacgctcggctagcttttcgcctaacgtcgtccttacgacacacgtcaagtatgcgccgtttgctgcccgccagaggaaggggcatatccgcgatgctagcgaacgggacctgggtgtgcatttagagacggcgcttagaggcgtcattgttgctgagcgctggcccaagagtggcctcgatatcacaatcaccatcctggaagcagaagatgaccgctggtggggcgacgcacccgattcgcatgatgctccttggggaatgatgaatgtattggctggatgcattaccgctgcgtctgcagcaattgctgatgctcgaattgactgtcttgaccttgtagctggtggtgtggctgccatcgtctccgacgaaccagcagagggtgaatcgtctacccctaagctgatgctcgatacggacccagctgagcacaagtctattctgtctgcctgtgtcgttgcctacatgccctctagagatgagattacggagttgtggctcaagggcgatcattcaaaggcatcattaggcactactgatcagagtctgacccacgaatctctcattgatggggcagtgaatgcagctcgaggtgcccacactgtcctggcagaagctgtgaaggagtctgctgagaggtttgctggtttaccgacaggggcaaacctggtgtaatcgtgattccgatttgtgcacatgtggcgttgttcaatatcatatatccttcactgtttagcacctaatgccatgcgctccctacgtgcttccgtttcctccatcctcttagggcttcgtatctactcgtgcagtctggttattcttacgaactgcaatccatggtgattccattatgattccacggcgacgatgtcatcatcaggtgaatcatttgctgagggaatcacgtcccttcatctcttcgtgttgtggtcatctatctatatcttcttctatatcttctacttctctactcgctctccttctcgctctcacccaaccttctcctacaacccttcctaaccagaccagacaaggcgtttgccaagtcaaatcgtactgccttctctctctattcaaaacttcaactacctcatcctccatcgctcttaatcaaccgtaaaaatgcctaagactcatcctaacgatggtctcgtgttcctctacatgtgcatcctgaattctgatctcaccaccgtaagtatctcttctacccaatgatcaccctctcttccgtactaatatgccccgtcagattgactggaaagccctcggggaggccaccaacctcaagcttggggccgcccgcatgcgttaccaccgtctgaagaagaacatggacgccgttatcaaggatggcaaatttgacctcagcaccacttctgcttccaccccagccaagaagcagagtttggacatgatcactgctaccgacaaagaaagcagtgttgagccaaacagccccgtggtcggaacctctgctggagtcgtcagcattgctgctcttcttaacaagtctcccaccaagcgcaagatggcagatgatgatgattctgaagccgagaccatcatcgatcccagtttccgggacttgcctgtgtaccctccttacatgcataccggtggtcctcttgctttcaagccgaccgcgaagaaggtaaagaaggaagagtgatgattcactgttctttacttgcttgctcactatatgggagctcagagagacggtattgggatttagtttgtggggatgaggccggctcctttctaagtattttcttacttaggggagacagttgaaatgaatgtggacggaaatcgggcttttatatttattatagtatttcaggcctttctctgttgtttagatgagattggttttcatgcgcccttagtcgaatgaagggtttctcgtcatatgtcggttctctacatctaagcgggaggcgtagactgagattgtagtaagctcaggcatttgtacatgactttccttgtacttgaaggcttagcgtagtctcatgcatgttggaagcctcacggttcgcggagttatgaccggcctaattcaccctcgagaatctcagaagcatggcaatgcgccatggtatgatagtgatctctaattctaagttcctatagctgtcctgcagaatgtgttgattggctatcagtgagatagatatttaactcgataattcccggtttatacgaaactgacaggaagtaagcactgaagctggttgggtatgttactattcataatataatagaagtagagggtgcatctgccattttggtgagtagtatcctgagttctccactggactatgggtgaatacatagaggaggccagatataataaccatgattataggcgtaaacaatatgaatttcatctacccggcctcaaggaatcgctatatagtgcagttaatacgccacacgcagattgaagcaagcccaccaagcctcttacaatgctaattgtcttcccccacaaccttgaagcacgtacatatgatagcgcatcgtatgatcatacgatcctgggtatacaaactacaccactacagacaccaggaacagggctcttgtactaaattagtcgatcgattgaggggggaagtgaagcgtggatggtaaccaatctcagtgcgctagttagcgtccatcaatcacatttgtgtgatcggagccgacagctagagtaggttagtcgtccgtattaagcatcttttaggcgcagtcgtaaggaccactttttttatcttctcgatattagggacggtccagataggtcagattttttgcgcatctgcctgtctagttctagttggaatcatatctccgtctgatattaatgctagtctaaggctgagtggagctgtcgggagtaagataataaataatgatatgcagggtatgcagtagatgaggtttgggaggtgtgagtacgtatgtagggagactggcaatatgcattatggataccttgtttttgttgtgccggggtactcaaatccgagcccaaaggagaaggagtcatggatgagatgcctctggatcagttttctactattgaacgaggtctcagttcacaatggccacagaattggttactctggttctcctccattggcataactaacataagagctcatcgggaagctgttggcagcttcaacttccggccgccggggataattcccagcgaggaatggtctcatttggcgtgtgtccccgtgattggctccagtcccctgaccagtttttgcgcggccttgttttgttggccttggaatggctctctttcttaacaagattcttattctccatctccaagtctccatcccaccagtctccagtcttttccgccatgatcgcatcttttgatttcccaagcaagcatggagctatcgcgcttcggcgtttcagcccctgagatgctcgatcttgctccattcccctcaatctgagaggatggttccatctccgatgcatggttcatagtcatttaaacttcccagcttgctcgtggtgagcccctgcggcttccactttccagcgagagacaaaattcaaaaagaggggcaagtgtgacgaggacgccgagagtggaacagctaattttaaaaaatgttcctgtcacaaaagcaaaaaggatccaacgtcttcgtgtcaaaacggcactgtcacattcctccgttagtgctgggcttccaatagcggcccagggtcgggcatctagcatgacctgcccctgtcaatcgatacggcgaatggggcggtttttcccatagtacacgcccgggatatgctggtgctcggctcgaacgaggtcttcccgcttagtgaccgggtcgtggttcgctgtcggtggacgatcaactacccgataggtgcaagcgcacgttcatcttctccgcgctaattttataggtgttcgtgtgctccattgcgcgtgaatactcggcttctgactggcgcgcgcattcggttggtccatggccctaagccgtcaactcctcgtcccatgaactctgtacctcctcgaccccgacccactccgctgtcgtctggcctatggttaccgtacgtgcctggtaaataacgtcaggtctggatcttttgctaatattggcatgatggcggtactagctcaactgcacgtcgtgcagatccaatttcgacgccctcgctgtcaggtggactcgggattctaggtttatgcatagtgggtttttgaggacgttagggctttgctctgctgcacgttcgacacagtcaccagtcagcgcagcagcttcaattgtgtgctgggcactggccgctgcgattccacaatggccacgaggagggggtccctgtaatccgtataagcacttcagaccgcgccattcgactagggcagacagctatctcggtgccatggtcttcgagtgtgaccggcgcaatgtgcatctagctcgcaatttcttttcactggtcccctcccgtccgccggctcagccccatcttgtgttgatggattacggagacctggaccacttctacccctgatacaggcaggaacaattatcggatctgcgaaccgggcagctatcctacgtagacgatccatcctttgttcatcgacgctgcttttctctcttctcagcttctcctccctccctcccttcctccatctctctctctctctctcccccgttattcttccctcccatcaccccttcatcttctcgagtacggagggcttttgcgttcagcgacttcgatatgagttagacgttatcatgacagcagctccagattacattccttttctacagttctcttttccgatctgatcgtcattgtcatccctcggaaagctcgtatttctagcatccgccagtctcgtcgcaccgatatcataagcatatctttgcacgcacttgagcgttgtcacgcgcataatatctagatcaggctatccatatggttcagctgcagctgttgacaccaacatggttgccttaaagcgcttcttccatgcggagaaatcttcaccggcaaacttcgacggtcatgacgctcgagcagtcagcccaggaggcgatgatcaccacgttttgcccaacgtgaagacatcccggcgcatggccgcggaaaatcagtgtgaagtaacgcacaaccagatgcagtcgagacccttgtcagctcgttcgcatgcgcctccgtctcgggcatcgactcgtcctccagtcccagcatctcggcacgttgatctgctcgatgctttgttttcttcacaccggtatcacatccaaagcgccagcactttgtcgccgattacaccatacaatgaagacatagccgaacggaacatggtgcccttcttgagaggactggcgctcaagaatacctactgctcgcgtccggtttcaactctgtatcaggaagaggtagcagaccggaatatctcgagtagaagcagcagtcgctccattccccacagtttcagcgcacgctctcgggctacaccacctcgttccaggcagggatcacagaggtatgtagacaatgctagggatcgcccccattcacgggcgaaaggcacgctgctggagcggtctatttctcctgagagctcagtctctgtacctcaattgcgtactgaggagcgccctggctcttccagggaaggggcctttcagagaagctccctgcgatctcagaggtctgcgcctgacttgctagctgaatggaacaatgcgccggaggaagaagccgtctcccgttcgaatggatacttgggcgtccctcctgctcacaagcaaggcgataaatggagcaatacgccgctacctgatagcccaacgctcccattatccatgagcagtgacggtatgagcgagactgaatcccctccggatacacagagtacccctccagcgtccgctcgtcatggcaacaaaaagaatatccgagatctttctataaacacgaagatagcagctcgaggaagcccgagcacgaagattgcacatcgggcaatacagccgcctactcccagtgctgtcgatcctaagcaagcccctagcattgcggaggttatgaacagccctctccctgtgggaacaccgacatccatctcatccttgcctcagtccaacgacaaagttatcgagatcatggacatgttcaggcaggcttttgcttcgacccaagaggtcacaccacaccctacctttgagagtctccaggatgctatcatcagggagatcaattctcacgaagcctttcagcgcatttccttccccaccgagccctcactcactccttcgccatctcaggaatcctttgacagagctcctcatgtgccattgtgcccaggaccaggtctggaacgaagcctttctgcaaaggaagggcaattctcgaagttgatccgcaaaagctccttcaaaaagcacaagagaagtcctgagcagcgcagaagcatatccacgagcgttcccgtaacggctttccgggcctcacagacaaccagtcgacggaggcacaccgacgctcctcttccctccccaggagtcctcagtaatagggaggcgaagcaacaaaataaggagagccccgaggagcaagtgacctacatggatcttctccaatcggaaagattatcccacaatcctccaagcaacccgggtcgtgctgtatccatgagaaccaactcgtcccatggcaacttaatgaacatgagcggggcaccatcagtcctacgcatgcgcgcacaagcctctccagtaagaatcagccagatcagctactcagaagacgacagcgacgacgaagaaatcatccaattgcccagcgttggtgggacaccgcacgtctgtatccagggtgtcgatcagaacaacgtcacctacatggctagaaacacgactccgcgaaacgcctaccggctcatgagctggcctcggaaatcaggtcccaatgcgcacagcagaaccaccatttccagcgaacgagtcccttcccgaacttcgtccagaaacggacagcagttctaggagaccgcattgggtgcagactcgttgctgttgctttcttgctaatgcttcactctcttgatacccctgtctttgacaatgatacccctcgccgtgttcccgaaagaaactatcgtcacgtccgctctcttacaacctataatccttaatccgttcctcgcatcccttcatttgataggatagtcccatccaacatattttcgatccctacaaccccatgagtgatacctctttgtctacccaacacagacagcccaggcgctctttcatctcttctatacaaaccacagtccttttactttgcatacggctttcaactttcagctcttatccagtcattccatcattcattccttattctctgcatggatttcgcatattttttctacactgcatctctcttttcaagcgtcctagcgctcactcttctgtatccttctctgactatcgagctgtcacactcacttgctttttccatccatcaccagcgaaattactaagtagacaacgaatccttatcaccacctaaaaaataatataatgcaaaaagactacaaaaaagagacttaagcaattgccaaaaacatgttctttcaattcgactcgctagctactgaaacgacctatatctgactcccccgatggtaaaccgatgaaaggtatctcaaggaatatcatatctgccccacccaactcgcatcatccatgcaattgtatgcatctaaactcctgaatttcacttgttcttttttgttctttttcttttctgaagacgcttgtaggcttctttttagggtccctatgtcgaactcaacgtgaaactgtattggcaggaatggaaaagtcataacagtcataggaaggaaggaaagtggatgatagaaagaattttaataaattgaaacatccggatccaacacggtagtagtagattgcgtttagtacgagcctgttgagatggttatgttagatatattgtaggtaagcaacgcaaggaatctggatatgaacttacggccgaacatgcaccacttctcagcgaagcgggtgcagtgggggttggtacacttggtctggccgggaacgataccctcgggctggtcgaagggaatgcagagagacttggcacccatgctaggagcgcgagcgtcctggggaatgccggagtcctcctcgtgcttgcgggcactcaggtccttgatctggtcctcacactcctcggtcaagcagtgggggatcaggcagacgttcttgtcgttcagggccggggtgaagtcgtcccagttggtgatgatcttgcggtgggagcggtactcggcgtcggcgcggttgtacagatccttctggatggtttccaggagagcgggcacggcggtggtcaactcggagatctgaatgggagccttaccgtccttgccggggacgtcacgacgagcagcggtgacgaagccgccggcaagctcgccaggaccgaactcaagacgcagaggaacaccacggagttcccactcgttgaacttccagccaggggagtaaccctctctcagatcgctctcagcgcggacgccagcctcgcgaagagtggaaacgaggcggtcgacctcgtcgtagagcttcttacgctcctcatcggtggtcttggcggtgataccgacggggacgatgatggtctgggtgtcagcgacacgaggaggaaggacgagaccgcggttgtcactgtggatcatgaccatgacaccgagggtacgggtcgacagaccccaggagttctgccacacgtggagaggagccgccttctccttgtcgtcgctcttggcggtggggtcctcgacggtgataccgaacatcttactgaagttctggcccagaccgtgggaggtaccaccctggataccacgaccggtggcggggatgtagccctcaacggtggtggtgtagagacctccggcgaacttctccttctcggtcttctgacccttgacgacggggacggccagaagttcctcgtagatacgagcatagaggtcgaggattgtcataacctcttcgtgggcaccctccttggtcaggtgggccgtgtggccctcctgccacaggaactctctagttctgaggaaaggctgggggtgcttgaactcccaacggacgacggagttccactggttgagcttgaggggcaagtcacggtgacttctgatccacttggcgtagtaggggtacatgacagtctccgacgtgggacggatagcgatcttcttctccagaggggtggagccactgtagcagggatgggtttatcagtggcctgtctatattgggggcgtccctagagataagggaacatacgcgtgtgtcacccaagcgacctcagcagcaaagccctcgatgtggtccttctccctctgcagcacatcctcagacacgaaaagggggaaagagcagttcttgacgcccatcttcttgatgtaactgttgaaccactgctggatctcctcccagatgaagtacgaagcgggctgtcgcatatcagtacaagtggttgacggcgtctcgggcgaacagaacaacccaccttgagaatgaagcatccggaaacatcatagtagtcaagcatatcacccttggtcagaacctgctggtaccaaccagggaagtcctcctccttggcgacatcgataccgatcagagcagcgccctcgatcttcttcttgggagccttggcagcgggcttcttggcctcctgcttgccaatccccttgttcgcggccttctcagccttgtcggcggcctgcttggccagcttagcagccttctttgcggcgttcttggagacctctccctggggggcatcggcttcggcggggttctgggagcgatcaggaagggtctggggggcaggggcctcgacaggagccgcggcgtcagcggaggtttggcttgccatgttgagagggagacaacggtcgcgcaaacagcagaggaggaccggatacgaagggaaggcgaagataagaggaagatctggggcgggaagaggggttgagtcaaagtgggatgcatctgcaaatcttcaccgcccggggccggcagaacttttagtgcaaacattcgaggcgaacgtccagcggcttcaggcatttggctgtcggagcttgtctttccccctatttccttcatctccgtctgtttcaccatcatggcaggcatctttgagcagccgcggaatgcggacaccctttgtgagtccccttaccaccccccaatctccttcccctgacagctatcactgaccagtctcgcacagtcttgggggggcagaaaatcaccggcgctgatgtgcgggagcagaacggtatgaactgatagattctcctcatccatgggggtgggatgctgatgatgatgtagtccttgctacgcaggccatcgccaatgttgtcaagagctctttcggtccgtccggtctggacaagatgatggtggatgatatcggtgtacgcatcatgtttcgaccccgcgttcaatatagagcagctccctgatggttttctaggatgtcacggttaccaatgacggtgcaaccattctgagtctcctcgacatcgagcaccccgctggaaagattctcgtggacttggcccaacaacaggataaggaggtccgaacccccgctccttgtgctccatactacctcttcctgttcacacgatgctgatttcaggctaggtcggtgatggtactacttccgtcgttctcattgctgccgaactcctccgccgcgccaacgagctgatgaagaaccgcatacaccctaccaccatcatcaacggttacaggctagccctgagggaagctgtcaagtacatgaacgagaacatcaccacaaaggttgagacacttggaaaggacagcttggtcaacatcgccaagacatccatgtccagcaagatcattggctccgatgccgatttctacgccaacatggtggttgatgccatgcaacaggtcaagaccaccaaccagaagaacgaggtcaagtaccccgtgaaggctgtcaacctgcttaaggctcacggaaagagtggtcgcgagtccattctcgtcaatggctatgccctcaactgcactgtcgcttcccaggccatgaagacccggataaccgacgcgaagattgcttgcttggacatgaacttgcagaaggagagaatgaagcttggcgttcagatcacagtcgacgaccccgatcagctggagaagatccgtgagagggaatccggcattgtcctcgagcgtgtggagatgatcctcaagtccggtgccaatgtcgtcttcaccaccaagggtatcgacgacatggttctcaagctcttcgttgagaagggcgccatggctgtccgccgttgcaagaaggaagacctgagacgtattgctaaggccactggcgctactctggtcagcaccctctctgatctcaacggtgacgagaagttcgaggcttcctacttgggacatgccgaggaagtcgtccaggaacggatatccgatgatgagtgtatccttgtcaagggcaccaaggtccacacctctgcctccatcatcctgcggggccccaacgacttcagcttggatgagatggagcgttccgtacacgactccctgtgtgctgtcaagcgtaccctcgagagcggtagcatcgtacccggtggtggtgccgtcgagacggctcttcacatctacctcgaagagtttgcagtcacagtggtacgtatcctcctccgaaatatctgagccctagctcaacactaactccaccacctccagggctctcgcgagcaactcgccatcggtgaattcgcccaatctctcctgaccgtccccaagaccttggccgtcaacgccgccaaggactcctccgagctcgtcgcccagctccgtgtccgccacgctctctcccagcgcgtccaggaaggcgacgccaacgaggaagagaaggctatcgccaagaagaagacgtaccgtaactacggtctcgacttgacaaagggccgtgtccacgactccctcaaggccggtgttctggagcccagcatgggtaagatcaagcagcttaagagtgctgtcgaggcttgcatcgccattatgcgtattgataccatgatcaagttggaccctgagaggcaggaggatgatggccacggtcactaatttatttagtcttgttttacgtatggggagttctccttgctttcttctagacctttgtgtggcgagggctgagagaaaaagtataataagatgttcatgagtacaaatttactaccttattaaactagtattgacgtatatgtttctcttggtttagtctggttgttgtatccttaaactcttgtgacaatgccctagggcgggtggtaaaaccggtgtattaatcagttcaaagcacgtcacatatgtaaagaagcagcagcaatgttcaatcacaataagaaataacagaagtcctcgttgccatgcaataaaatccgacgctatcaaacacaagaaagtagaacacctgaaagggggaacaagagatccaaaacaccctgctaaatcaaacatctatgcttcttccgacgccatacaatgcatgtaaacccggtgaaccgtaaaacaaaaaaagaaaaagaaaagacaagacaagtacgtagtctttcaaatgagtcattcttcttcgtcatcataggagtctggggtctctgcccagccactgcgccatctctttccttctgcctctccactggttctgaggtctcgggcttcaggtccttcgcgccagcatcgggcggtgtagtcgtcgctaacggtaacaagttctccatcggcagtccatgacacggcggagacttctttcacatggcctccaacaaggggtgttccggactggtagatgggaatggtgtcttctacccgtccggagtatgtgcgacggaggccggagcgggtagctgatgacggcatcgggggtagaaaatcatcctcagtggtcgtcttctgatcattggagaggaagcgctcatctgttggaaagaggacggcacagttgtcggcactcccggcagctagcatctccggtttgtcgcctgtggctttgcgaaccccaactttaacatagaaggttgcaacctgaagacgtggatgacggaagccatatagaggccccagcccttccttgtcagacccaccggtgcgacgtggtcggttgttgttcagagagagctcgggggcacttcccaggaccagatgtgacgttgagtaggtgtacacagtgccatcccgacacagcgtgtatagtcttgcaccatctccgcccaaggccattgacgtgacggcaaagccccggtatttgatgtggctatctggctgtctggtggtagccagaggaagaactggacggccacgacggttgttgtgtgctgtacgcagatcccacaacctcacgcaggagttcgtactcgaagctgtgacaaaaaggttctcgcgaccttgcggaaggaaggccaaagaggttacggtaatgtctgaacggcgaacttgaggttccattttctctggtgacacgcctgtttgcgacgtccatgcatgagcgccgtgaatagtactcaatacctgaggaaaggcggtcttggaggtgatggagccagcagtcgattctgcgtcagattcaagcgagcaccgcgcctgcagactaggtctgtcaaatcctttgcatcggagatcccatatgttgacattgccatcacgactgcaggtcgcaaggactttgttgttggccgctggttggaactgaacctgcttgacggaggacacatggttggataggcaatataccggcgtctgagtggccatgtcgatgactagtgctgtttggtctccagaggctgttgcaagtagcatatcatcggacgaaaactgcaggtccatgatcgaattcgtatgcgggcggaacgtaaggtatgctcgagaaaagccgctcttgtcgtctttggcagaatctaacaatcgaatgcctccctcctcatctcctactgcaataagactattggctgttgagccagtcagtaagtacacgcagacagaaagcaatcctgttgtcacccactattgcatgaagccgtgcagaacggcaagacgtagcggtcaccagaaatattggcgcagttgtggctatcatttggtcgtgaatagaagtttgacgtcaggtcctgccagccttcaaggactatgagtatatcgttacaaaaatagaggcatgtgcaacctaccagctcctgaattagaccgtatagtcactctattcgcccgagaccccgaaaggcttcgcatatacagcgttcccgacgattgcaaggcctgcgaccgacggactggcagaacctgtcgagtaggttttgtgacagcagttggcttgacatcatcaaccctcgattcaatcttgagctggatgtctcgaactggtacagctacttcttcgtcattctgggctgcatggcgaacctggacctttttaagcggcgaagactgcaacggagaaccaattgaagagaacgaaagcttccgtttccgggtcggtgttcgtgtgaagtcgggtgcttctggtctatgttcaacagctttggatgtccttgtaaaggcgggccccaggcgattgacggcaggggagctgagggctttcaaagcctgacgattggttctcactgagcttgcactgttccctccatccagcatggagcgaggcgtaaaaaaccgtcggaatgatcgtggagtgaccgggggaggcttcttgggtttgcgtcggtagccaacatcggacgctatcgagggcggcgaggagggaagctcctgtgatgttggaggaaagacgggctcagaccgaggtacttcggggagatcatgcctggcatccattgtgctccacagacagatatagacacacggacattctacagaaacaaatgcatggggagagggggaagagggggggtaaaaaaggacgaggttagagagcaaatggaggcatggcgagtggagctgggggccgtggatgatgtcctccaggcgcggaaaaaagggaaaagtctcgtgtcgacgtgccttttcgtgtcgcgcctgactggaaacagtaggcggtgaatgtatccattaaggtggttcgagaatgggcggtatctcccaaacaagaaggcggtcaacatggtgatcggcttttccgtccagaaattttaatttttcttgcattgaagaaagacgatttgggagctttggagcagctcatcgtgtccgtacctttgtttcggacacttcacacttctgccacgatggctccaatcaagcgcaaaggcaatgccgcagaggaggcatctgcccgtcaaccccagaagcgtgtccgtgtcggagcagaggatcgcaagaaggaccagaagaaacagaaaaccgcatcgaatgacagcaactccaagccggacgcaaactctgcgcccaaggcttcggagctttccgtcctgcgcgatgacgagccttccttccctcgtggtggtggaagcgttttgacgcctctcgaacgcaagcagatccagattcaggcaacgaaagatgtcctcttcgagcagaagggttccaagccgtctgctggcgactttggagatgatggaatggaagatacagatatggaagacgctggcgacgatacgaaatcagctgccgcgaagaagtctcgcaagaagaagacaaagggaaagaaggatgcagagaaagatgcgacggagaaaaaagatgttcgcattgagggtctcaatttcaaggtatgtttttggaagggcaagtgaggcaacatatgcgcttcttgaagcttacagaattagcgaattgtaccgggcactatggtactaggtcaggtttcgagtatcaacgctcacgacatcggactgtccctgcccaacaatctcactggctacgtgcccttaacatccgtgtccaaggtgctggaagagaagattgagaagattctcaaggatgacggaagtgacgaggaggaagatgatgatgaggacgactcgctagaccttcacaaatacttctatctcggccagtatttgcgagcatacgttgtttctgcgggaagcaatgccgccgatgccagtgccaagagcaggaagcgcattgagctttcagttgacccaagacaggccaactcggggctttcgaagtcggatctggttgtcaactccgctgttcaagcctcggttgtcagtgtggaagatcatggtctggttatggacctgggtcttgagggaggtgaggtcaagggattcatgtcttccaaggaggttgatcccaagactcaaccttcctctatcaaggaaggctcggtcttcctgtgtatggtcactggccagaacgctaacggcagtgtcatcaagctgtccgccaacctcccgtccgccggctctatcaagaaatcacactacctcagcactgctcctacaattacctctttcctcccgggtaccgccgcggaaatccttttgaccgatgtctcgtcaaccggcatggctggaaagatcatgggcatgttggatgccacggtcgatctggtgcaatctggaggaagctcaggaaaggacgatttgactaagaaatacagcactggcgccaagatcaagggccgtctcgtctgcactttcccctccgctgagccatacaaggttgggttttcgctgctcgatcacgtcgccaagtttgccactgagggcggtcccggttcctcggacgacgcgcccgccatctctgccattgtaccggaagctaaggtggtcaaggtggaacccggtctcggtgtgtacgtgcagatcggttcgactaagcatctcggattcgttcacgtgtcgcgactctcagatggacaggtggaaaccatctcgcctgagcttggacccttccgagttgattcggtgcacgagggaagagtggtcggatacagtgccattgataacctgtacctcctgtctttcgagaagaaagtcattgatcagccttttctccgggtcgaagatgtgaccctgggtgcagttgtgaaaggaaaggtggagaagcttctcatcggagccaacggtgtcgatggtctaattgttgccctcgcagatggcatcacaggtctggttccgtccatgcatttcgccgatactcctctgcaattccccgagaagaagttccacgagggtatgactgtgtcgacccggatcttgtcggtcaacttggagaagcgccagatacgcctgacgctgaagaagagcttgttgaacagcgaatctgcgatctggaaggactatgaagagatcactcccggcacccagtctccgggaaccatcatcaagattcagccccatggtgctgtggttcaattctacggtccaatccgcggtttccttcctgtgtcggaaatgagcgaggcatacatcaaggacccttcacagcacttcagacttggtcaagtggtcaatgttcacgccttgagcgtggatgcctctcgtgagaagcttgccgtctcttgcaaggatcccgagactttcaccgaggcttacaggaaggcttttgagaacatccatccgggcatgcttgtctctggtacggttttcgagaagtcggccgacgatacgcttcttaagctggacgactacggccttgtggctcgactcaacgttgagcatgtggctgatggctccccttcgaagcaggcttctaccctttcaaagatccgcgttgggcagaagctcaatgaactgatggtgatcgacattcagcgcgcacatcgcctcatcaaggtaacgggtagacagagcctgaagaaggccgccaagcacggctcaattccgtccgagatcgaggacctcaaggaaggtgccgacgttacgggtttcatccgcaacatcaccatgaacggtgtctttgttgagttcttgggtggtgttattggtctcgtacccaagcgacttgttggtgatgaaaatgtcaacaagccggattatggcatggctcggggtcaagtcgtcaccgccaccgtgcattcggtcgacgcagacttccagcggttcatcttgagcatgaaccctgcggaggccacccacgccggtgcgaagaagaaggctgcggctaaacccgaacccactcccactgacgatgccgtcgctaacgctatcgacgagggcatcaagtcgatgtctgatttcacctttggaagggtcacaaagtgcaagattgtgtctgtcagagcgactcaggtcaatgttcagttggccgataacatccagggccgcatcgacgtctctgaggtgtttgacaagtgggaggacatcaaggatcgcaagcagcccttgcgcttcttccgccccaagcagatcatctccgccaggattcttggtatccacgacgcccgcaaccacaagttccttcctatcagtcaccggtccggaaagttccccgtgttcgagctttccgtgaagccaagcttcctgcaggccgccaaccccagtcctctgaacctggagcaggtccaggttggctcgacatgggttggtttcgtcaacaacgtggccgatgactgcctttggatcaatctgtcccccaatgttcgcggtagactgcgccttatggacgcttccgatgacctgtccctccttgctgatgtggagaagcactaccccgtgggatctgcgatgaaggttcatgtttccgcagtagacgctgacaagggccgtctggatctgtccgccaagcagcgctccgataagcttgtctttgaagatgtttcggtcggaatgattctgccgggacgagtcaccaaggtcaccgaacgacaagtcatcatgcagcttagcaaatcgattgttggtgctgttgatctgattgatatggctgatgattacaccaaggccaatcctactgtgtgccagaagaacgaagtgctccgcgcgtgtgtcattgccatcgacaaggctaacaagaagatctccctctctctgcgcccgtccaaggttctcagttcctccctgcccgtccaggacaaggagattacctccattaagcaactcaaggtgaacgatatcgttcggggtttcgtcaggagggttgcagacaacggactcttcgtcacggtcggccgcgatgttactgcttatgtccgcatctctgacctctccgattcctatctcaaggagtggaaggactccttccaagtcgaccaactggtcaagggccgtgttactgtgtccgactcggagcaaggcaagctgcagatgagcctgaaggagtccgttctggaccccaactacaaggctcccctcacgctccacgacctcaagcctggccaggttgtgactggtaaggtccgcaaggtcgaggagttcggtgccttcatcgtcatcgacggttctaaaaacatcagcggtctttgccaccgcagtgagatggctgagaatcgtgtggaagatgcccggaccttgtacgaagagggcgacgctgtcaaggccaagattctcaagatcgaccgtaagcaagagaagatttctttcggactgaaggcttcttactttgatgaggaggaggatgaggatagcgaggaggatgacgactccgaaggcatcagcttggatggcctcggtggcgttgatgttgagggcagcgacgacgaggagagtgacgtttccatgggcggagtcgatctcgaggatgatagtgacgacgagtctgaacaaagcgacgacgaggaaatgactgacgcgccagctaaggcaagccggcaagacggcggtctcggtgctggcggttttgactggagcggcaacaaccaggacgacgatgaggctggtgctcgctcagactcggatgacgaggaagattcgcgacccaagaagaagaagaaccgcaagcccgagatccaggttgaccggaccggtgatctggatgcgaacggaccccagtctgttgctgattacgaacgactactgcttggtgagcccgactcctctctcctgtggcttcagtacatggccttccagttggagctgggcgaggtcgagaaggcgcgtgagattgccgagcgtgctctgcgcaccatcaccatcggccaggacgccgagaagctgaacatctgggtggctatgctcaacttggagaacacctacggcaatgacgacactctggaagacgtcttcaagcgcgcatgccagtacaacgatacccaggaggtttacgagcgtacgatcagcatctacatccagtctggcaagaacgaggtaagtcttacaacattttcctttatctctcttcgtgtgctaacggaatcacctacagaaagcggatgacctcttccaaaccgctctcaagaagaaggtcttcggatcccccaagttcttcatcaactacgccagcttcctgttcgacaccatggctgcccccgagcgcgctcgtgccctgctgcctcgtgctctacagtccctgccttcgcacacccacgtcgagttgacgtccaagttcggccagctggagttccgctcagctaacggagacattgagcgcggccgcacggtgttcgagggtctcctgtcctcgttccccaagaagatcgatctctggaacatcttgttggatctggagatcaagaacggcgatgccgagcaggtccgccgtctgttcgagcgggtcctgggcatccgcgatacgaagaagggtggcgctgccgccgccgtcgaggccagcaagaaggtgcggcctaagcaggcgaaattcttcttcaagaagtggctctcctttgaggagaagcttgcgtcggctgagggtggcaatgataagatggtggaagagatcaaggccaaggcggccgagtacgtcaagtccttgcagcaggagtagagtgagcattggtgtttttgtttcttctttttgatatctgggacatacttagacatgatgtgtatcttgtatatataaaaaagcatttttcagacatgtttcaaatcttccttctaagggtattggtagttattatctacaacaatgcaacctccatctatacctaatacttgcccaacacagcctccggatagacaaacagagagatgaattactgccccctcctcttctcagccatcaacctccgatactcctcgacaatattcctcctctcgcttgccaactcctctctgcgtctcaaactcgtcgctccaccagcagcaggcacattcgcaacatcgaccttcgcccctccgcgcaccttgaacacctccctcggcttcgtcaactgcggcggcgcctgcaccacatccaacggactaatctgtttattcatccgttccttcttcaacttcgcccacggatccgcctccaccttcgcctgctgctgtggctgcaaccccttcttcttcgccttccgcttgcccccctccacctcccactccttccacagccgcaactgttcatccatctcctcttcgcgctcttcccgctccgccgcctccttctctaatatctccgcctcctccttccgccattgcgattgcagtcgtcgtaggtgcttctcgtgcttcgtcacccgcgtttcgcggatcttgggcacatctgttgcggacggtttcgcgctgcgggacatgtgggagaggggcatttcgcgatcgacgcgcgccgcgaaatcggagagcttttcgccgggaaggatttggggttttactgcctttccttcggcttgcgaggtttcagtggtggatgtagtagtggtggtcgcggccttcctcttcttgttgttcttgttggttgtttggggagtgacatcttcgtcggagtctgatgagtcggaatcttggtgtttacgcttcttcttttgtgcgccgttctgttgcttttgctggagttgtagcaagtggcggaatgcgcgcggagtgtcgtcggcccattctgagttggatttggatttggctttgcgttccccaatggcttgttttgtgggcttggctggtggttgttgtttgcctttgccgcctttgcctcctttgcctttggtggatttggagggatcgcggacgggaaggggtttggcgattacgttgggggggagattgtaggtgctgttgttgtggttgattaggaggttgtagttgtttatgatgggtaggggacttacttggcatccttttcgcgacgcttgtgtttgtgaggcattgtggtggttgtatatgtagattgttgtggtagatggtatcggtgttggtgagatcgagttgaaactttttttgagtttccttttcgggtgggcggcgtatcttatcgccgctgataaggatggaatcttaatactatctatatctatctacggaatacattggagacttggtggttcaggtctgagtctggttgtttctacatggtatcattgtgtatactggctgtcagataaattgtttcgcggtattttcatttattcctagtgagtgtttgatttggtgaaaaggatcaaggatggtatagtagccctgtgatatatgttggtcccttcataaggctagcctagaatatatattccggcctattaaacagtactaatcgacagcatagggcagaactactgtactagtacatgaaccgaccataaaagggacaatagcaaataaataaaatcgttaatatatttctattaatcactgacccaattagtatttctaagcattcaaccaccaggctgaggagtgtaatccgtacatccgaaatgcaagctagcctgacttcctctcggatatagaccaccagttaaaatgcgatgtaacgctggcctacactgtactaacctgaagccacacaacacactgtcattcgacattccttaatgtctcatacaatactataagtgacctccggttctagtctatcatcccagcaacaaccagtgttaaccctaccgtgtatggagtaatagtaatgtgttggatcgactagcttttctagtaccactcacactcttgttgttctgtaccgctgcaggcagcctgcagcctgcagttacggttagtgcgagaagtctggtccggcactaatcaattccccgatcacctcatgcttgctctctggataagtcggcaccatagaatgtcgtccaaaggttccatccacatccgctgctgttccgcgggattttatttttttttttcgccccgcccctgtacgttgtgtctcacggtggtggccgtgtcactttttttgatgatccttgagggggacgtgttaggcaaccacctggtctttttggttcttgccttatagtgattaattactattaaaatgcttgtgatgatgaagaggtaagacgggaagacccttgaaactagtaactaacccaaaaatgtctggcataagcactattactcagtaggaacaagacttcttaggctggatgaagggtagtttgaacgggccaataatcagggccagtgccgcacatgggcttgttggctcgtacccgacttgtcctggcttgacagaaggattgtcgtatatttctacaggatgaacatccatggatgggggaaaacggttagccagctaccgcctgtgtacggacaggtctgaacgaatcccgagtgtggtcatcagcacgcagagagagagagagagagagagagggaaatacgagggtgggtgacatggttgatcggtgaatatcaaaattaaatatgactgtgacaaccaatttacctttgagagtggagatcgcttcaccctcacatccttcatcctttcccggggccctgcggcaactcggctgcaactgatggaacccactgcacttcccttccccccctcccctccagggcactttcccccccattgaatgagtgaatcatgggacgaccgttggtggtccgggcagcttctcgctcgatttatcggaatttgcctgaccctcgatgtaatataaaccataaaccatccccatcttcccctactactactgccctctttcctcccttttggttcctgactagcagtgagtgagtgagtgagtggacaagcagtatggcctcttcgtctccctcggcctaccctcattccaccttccccaatcatgacgataaaagtcaattggaccggtttccactagacaaggatttggagacgagtactgccctcaatgacctggcctacgatgctgatgtagaagcatcgcaattgtacgcgccaaagcgaccacgatcggggggcatgcggggaatcgtctctcttatcgccgcctacttatcgccgcgggagaacaaaaagaagcatcaccgccagcccgccgacgctcgcccattgctcgcctccgccaacaacgccactcccactgccgcctggcattcctcctcgcgacaatatcaaagactcaaatcactatcgcagtgcttgtgttaccctcttctgggactcctcgtcatgctgtgagtcgagttccccacccacccaccttgccttcacctcttcccctaatgggtgagtgttgccgtcaactcacctccagcgttttaggggcgtcgtccagttcatctccatcgcctgcagcatcgctgtctccttcttccccgacgaattcgaccgcgccatcgagcggtggcgtcataacgatcagcgatccccatccgcggacatactgcattggccaacggacatctccagagatatcgtccctgtggcatgccactctcacaatgactactggcgccccgtgccgttgttctctgccctgcaggctggttgtaccggcgtggaggccgatgtgtggctcgtcgataatgagctctacgtcggccataccatgtctgcgctgacgccccaacgaaccctgcgcaacttgtacatcaatccgctgctgcgcattctcgaacagcaaaaccccatcacagacctccaccctcagcgcgacagtccgccgcaaggggtcttcgacatggatccctcgcaaaccctaatcctactaatcgactttaaaaccgacggtcaagaaacctggaactacgtgcatgcacagcttgccccgcttcgcgagcgcggctatctttccttcttcaacggcaccgacatcattccgggccccataaccgttgtcggcaccggcaatacccccttcaacctagtcacggccaacactacccaccgcgatatcttcttcgacgcaccactcaacaaacttgtcgacgacaatatcaccagcgaggactacgacgacgacgacgacgacgacgtctccctccccaacgcccccggaggcgtacaagacacagggatagtcacccgcgccaccaagaatgtcggtcaaggtctctccggcatttccgacgcagaaatcggccccgacacctttgattggaccaatagctactacgcctccgtctccttcaagaaatccatcggcatgccctggtccttccggctctcccagcgccaagtcgatcagatccgcgcccagatccgcgccgctcatcgccgcggcctaaaagtccgctactggggcgtacccgcctggccacggagtctgcgcaaccatctctggagcttactcgtccgcgaaggtgttgattatctgaacgtggatgatctgcgcagcgctactcgtcaggattggcggcctagaatctcggattggtggagttgattgtaaatagttcctttctctttctttcttttttttttttttttttttttttttttttttctttacttttctcacatacatcgcatgcaatgatcccccacgctattcacctggtgtgatgcatgatcttctacttctagacgatgatggcgacagataaagatggcgttttttggttttgttccttgttaggtagatacccacatgatggttttgggtcatttttctttttgaggaggtctggtttaggtttttgctactagttgttgttgaggggagatctgggggttgattggttggtttactagatagctgcggcagtactactacagagtagatgatgctgactggcattagataagagaagaacaacttctgaacatctttggtacgatctgagctgatgatttctattaagtctccgtggatggattactttggactgcaatctcttggtggccaaaaataactgtttgattgaaacatgtctgtttcgggggatgcatgatccgggtatcatctatctatcaagatagtaaaaaaacaggaaaagataactggctagtccctcccgagggacgagcaaaaaagacgtagtatgtatgagagataaggtacctatgtggataggtagatcacatacaaaacaacgcctcctcgccgaactcgcgtaacaccgtgccctcctcgcgcagaatcccacccagccaatccttggccgttgcaaattccttcgcgccaaatttcaccagcacaaacccggcacgcacccgtgctgccgtaaatgtcacctgagaatcatagttgggcgtggactccatggcggccggcgccgaggaggcccaattccgtgcgccaatcctcggcagcgaggtaaaccggtccatgatgaaagacgcaagcttctcaaagaccggcccgtagagaatcaaagtccccacgaccccatgcggtcgggtacgctcccgtaacaaatcactacggtcgcatgcgcccgctccgttggcaagaagggccacgtcaacctcgtcatcgagaatgagcgagtctcggagcagcagcttcttctttggtagtgctcccttcccgtctgttgtggtagtccatacctcgttcttgcctcgccatagatggaagtcccagctctcaccacgggacgtccggccctctgttacccagtcgagaatgcagagactgctcttgttcagaccgtcgacggtgaacgtctggacttgttcgtagcggctgtctttgtatggtacagctgggtctggcagatagcagagggcagcaccctcgccgacgtgcacatctaatgtttgccgacttttgtcggagagggagtgtttgagagtgctgcggtggcccttcatgctggtgggctcagttttgaaaatcttggtgctcccttgtggtgttgtcacgaccatgcgggtgtgagcttcgagggtaatggagacagagatgtggtcgcctggtagcaggcctccgccgtatgtgagaaggtagaggtgaacggggttggaaggacattttgagagggcggagttctgcggaacgaagccggggacccgagtgaggagtttgagaggatatttataggtgagggtcgtaagggaaggatttgatggagggaggagggagagaaccaccttgccatgaccaggctttgcgatggaggactcaaagggagactttatcggcatggttgcagattttttgtgaggtacatgaacaactaagaagtagaagaacaagaagaaggaagatagcgagggaggaagagagatgaattgaaggtggatattttatgggtggaggaagaaggaaaagagcgagacgaagacggaatgcttggcttttaaccgcatggtcgagcagttgctcatcgcggcgtgagaggagaaccagatgatgaaatggagctgggggtgacgatgtttgctttccccaggtccgggccagacgttgggggggggggaaggggagggaaggagtggactatcgtcaggcaaaaggaacagctgatgggctgtgctactgcgcggagagaagatcgaggatcgccagacttcaatggcgtcgcaagaatcagcaacgaggcggggtcttgatggagatgactggaatttgatggtctggcacttcttggcccttcaatcgcgtcttttttaggaagtcgcgatggagccccccgtggtttccattacggcatcgattactccctcctccgcacttcccgctttggggcttgcgccagggctagggttggtcccgtcacctggtcacctgcccgccagtgccaagcgtgcaccttccctctttaggagtagctcggtaatcatcttttttattcttttccgcctgtcagtttacaccttccgtacaagtcacgggtctggattgtgtattattgagaagcggagtttgtcgcctgaggctgccacgtctgctggctccccgtcatcgccaggcaccaaagcgcgtcgtccgtcaacaagccaaagtcaagatccccaaagtccctcctccgtcgtcccatctcccccccctccctctctcctccccgtatcgcttgggtcccgctcccgacttccgcatgtcctcaattgcttcctcttggaattgattcatccttttttttacgattcttccccgcccgctgtccgcgtgttgcaacgtgccttgaacgcgcgcgcaaatcccggatagacattgggaaaccccccaacatcgcgtttgacggctcccgtttcatctctaccttggcgaatcacccacccccacgtccaagtacgctctacgccctgcaaaatctccagaggatcttcttacaatcgactccgttggattccgactgaccgttgttccgacttacagtgatataatatctctccccgacagacagacgacatggaagccgaatcgcccctctcaacaccccagccggatcacacccagagtgatgcctccccgtcaacagacaggaggaaatcgggtcgcgtgacacgaaaaccagaactgtattcccagagctatggcgccagcaatggtgcgaccgcaggcggggccaaacgcaagcgcaccacgactggcgatgataacgatgatgacaatgaactaagcaacgaggacgcgtccgagtcagacagcgatgagcccggcgacgaagatcccgacgaagaggaactgcgcgagaagaagcgggcggcgcgcaaagcagccgccaagaagcagtcgtccgcatccaaatcaaagcccaagtcccgtaccgcgaagaaacccaaggtcgctggcaacggtctgcctagtcgcctggccctacggcccgctgccaatggaaagaaaccggtttcgcgtcccagacagatgaaagcgcgcctcaccatggctgcgcgcgagggtggtctctatggtaggtggctgaccccaatttatcccttggcgtaaatgctctggctgacatagatttctctactagcggaggtctttggcaagggacggaccgtcgaaacagttgcggcggaatggcttacgcattatcaagaagagcaacaggaggcagtgtgcgacatggttaacttcatgctgaaatgctcgggaactgatctggaagtgacgacggttgatattgaaaatgtcgaccacgccccgcaccgtgtgtctgatttggcaacgcagtaccaagaactaggaatttccgagtaccctttgatctccaagtccaggaaactgaggtctttccaccccgttttggagagttttatcatgaccctgatccaaaccctgcaccactcgtccgtgctatacaacgatccgaatcttatcgaaaacatccaagtttggatctcgtccctgtcctcttctgggtgccggccgttcagacataccgctaccgtcgtctccctggccacgatgaacgctttctgtgatattgcgcgggaggtcaacaccactgtctccacgtcccgcaaacagctggaaagtgagaagaaaaagcggtcagtgaacaagggccgagccgaagccattgagacagcgatcgaggagggtgaaaagaagctggaaatgatcgacgactacctgaaagatggtgtgaacgtcgtctttgtccatcgctaccgggatattgaccccgccatccgcgccgagtgcctggcagcgttgggacgctggatgcgcacctaccgcgagtatttcttcgagggccagtttctccggtatttcggctggaacctgtctgacgccgcgggccaatctcgtgcagtggtggttgagcagctcaagtccctctatgaaatcaaagacaacatggcaggccttcggtcgtttacggagcgttttcgccagcggctggtggagatggcggcccacgatgcagagatcaccgtgcgcacttctgccatcgagctgcttgacctgatccgcgatgctggattgatcgaaccggctgatgtggatacagtcggcaaactcatcttcgactccgaaccccggattcgcaaagcggctggtcgcttctttgttgcgaatgtcgaggatgtgttcgattccacgatggaagagatggcagaggaggctagcgagatcttcggtgacgaagatgaggacgatttcgagtcacccaagcgctcttggatcaagttcaagtgcttagcggacattctccaagcttacgacgatctcgagaatgaaagcgccgaggaacccgtggcgccacgagatgcgctttcgggtgctccgatggacacacgtttcgtccttgctacggaagccatttatccccatctcaccgaccttgctcactggcagtctttggcaggttaccttctctatgaccattcccagatcccggaggaacccagtgaggatgatactgctgccgtggtccggaaatcgtacaagatgcaagagggccaggaagtgatccttctggaagtactatgctgcgcagttaagctgcgcgttcttgagattgccaagtcagacattgataagaggggccgaaaagtgaaggcattgaccgacaagatcccagaactgcaggaggagatctcgcacagcctggcgcagataattccgcagctgctaaacaaatacggctccgtaccggaggcggcatttgctgtcttgaggcttgaacatctggtcgacctggagaagatcgaggatattcaaaaagacgcgacagcttatacctccttgttgaacgacataaacaagcagttcctaacccattcagaccaggatgtcctggctgaggccagcgttgcgttcatccatgcaaagagctccgatgatatgcgtgaggcgctcgagggcaaaattcaggagttatgggacaacatggtagagactctgagtactctgtcacaaaaggaggacgtgtcaaagggaggctcgatatctcccgctacattgaacgaactcgtcaacacagcgatccggatatctaaccttgccagtgtaactgactgtacgcatgtcttggaatccatgccctctggtcgatcaaagggtaagcgcgcaggcgtttctgaagcacctttcaacgctcttgtgcatttggtgaaacgggggctgcgcgacccggaggacgacgaggatctggccaaggcagaaagtgaactggttaccaacagcatccggacgcttctgttctatttcatgtggaaggtgcagacattaaccacggccctgaatgcagggaaggcatcgtttaatacggcatacttcgaggctctgaccaagggccgtgagatcttcatcacaacacttgttgctatcatgaagcagcgcttgggattggatgacatccggttctgcgcggccacgacgctcctagaccttcagaccctgttcggcacccttcgccatgctggactgagtgcggccaatgacgaggatgtgatcctccagactcaaagtcttgttcaagaaattgggcgtgagccaaagacgctcatcgccaggatacattccatagcagaacgcacgtatgcgagaaagatacgagttcccataagggctgccgacgacgacgggctatccgacgaagacatccggaaagcaccccaggatgaagacgacgaagagtctgaaccagaagaaatcctggatgacgagcgcctccgatcgagcattattgcagaacagcgcttgtgcgaactgaccggaaaaatcgtcctcgccatcgtcggtcgcattatcgacgctaccggatcagacagtggagcattaacgaagaaactgctcaagaacaggtcccagctgggtcgaaactaccgtgaagtcctcgcctatctcggagaccgcaagcccagcaggagcacagcaacacgagccgctcccccacgaagtaaacaacagtcggcgcaaagcaaaacccagaatggtgccggcgccagcaagcgagcaggagaccttaaatccgccgaacggatagacgacgaagaagaggacgaagatgagaacgacgctgaagaggaatcccatcacgaagatgacgaggaagaggatctacgagcccgtggccttctcgaagaggagaacatcgaccaagacaatgacgaggaggaagaggatgaggatgacaatccagatccagatgaagacgaagttatgggtgattagatttatccttatttttatcgtatcattcatgtcttgtctattccatttgatatctttttttcggacgaaaattttactagggaaaggcacacgcaatgtcagggtgtcaatttgctatgctaggcccatttgtatcttttctattcgattgtgattcggtgtgatgactttttatatcttcttcttttcgattctccctcctgtcctttcaattccatatgcggggtcttattttttttcttttatttcttttcctactaccccccggctttcccacttgctgttactactatgtagcctggcctgatatcactactcctcgtttcttgatttacatctgtctccattacacccgccttttttccagacaatgaagggattattcgcagactgtacctttctctcaaatctccgtagattgtcgacctaagtttattttacgctctacggactttttccttgctcccttctattatttttcctcggacaaaagtattactccagtcagttgtgtcacctgtattccagtggtaccattcccttactgtattactgagtatagtttgacttgtgtgtctatctatcttatagggtatcacattcgggtgcggactggatttattcaacgcagtggatgagtgacaaggggtttggaatcatttgactggctggactgatagtattgagcgactaatcaagtgtatatatagactattttgtttcatggagttgactacttggaagttccaaaaaagttttggatactcgtaaaaagacgtaagtgtggtgaaaagaaaactgtcaattttaagggctaggtctactatccatcatggctgagtctgttggatctcgttgagttatactaggtttgttcctgtatctctaaggaaaccaaaccacatccagggacagagccagtggcctgcatatgccgacaccaacgcctagtagtattcctttatttttgtctctctaggcggaaggggacggagagcacctaggcccgcaaaacaaatcacaaccgaagggaacatccagaggaaatgaacaagaatgagaccgaaataaaacaaatacgcctgtgtatgagggatgctacggggtggtaccagagtgatgggcacgtataaaaagggatacatgatggtgaatctttatcgttcgtgatggtcaaaacagagggggagaaatcatgatacgggaagggaaaagggaaatgggtgagggggaggacagaagggggtaagaatgtggaaacctgggagggcaaaacaagaaagggtctgaagagactgcgaagttactccaacaaggatggcgagaagccacattagacaccgctgttcttgagtcacgagaagcctggaaaaatgaggtgaatatcccgtcccagggcctccacgaactcgaggttgagggtccacatggcggcgtggtaaccgccaggtgtagatctagcgaggaagtagaatcgaaatagatgggtgcagatctctcatgtgggtcatggtttcattgccagtaaaatgcgtgtcaattttgtttcttcttttacatatccatggagtcaccaccgttggcgaagttgaatccgccctgctgttgcgtggtgccgagggcgaatccagtctgggtctgctgaggagcaacctcatcaatgtcaccagcctcgtcctcatcagagaagtacttctcgatgatgttgtatgccttcatgtagatctcctcgttggcgttgttctggcagtcatggatcttctccataccaccggcctcttcgatgaacagagcgtagcggttgacgttggcctcagactggccagcctccttgtccatctcgccgaccttgaggatgttctccagaccatccagagcaacctggatgatcttgttgtcagggcaagcaagaaggtcgcacaggggcttgatgcatccctgggacacgaggtagcggatctggtcaggcttctgcagaccaccggaggtggcgttggagatggcccagcaggcctccttacgcgtcttgaagtcaccgttcgccagcaggttgatcaagggagggatgatgccggcgtcgacgacagcctggatctggctggagttaccagcagtgatgttggagatggtccagcacgcctccttacggataccgtccttggtggagctcagcagagcgaggagggcgggaagagcaccgcagttgatgatgacctgggtctggacgtcgtcaccagtgacgatgttaccgaccgaccggagagcgggggtctggaccgaggtcgaggcgtgcatgaggagctcgacgagacggcgagggatgccggcctcgatgacagcctgaatcttgtcgttggcgccatcagacaggtaggagatggcccagcaagcatcgatcaggacttcatcatcaagcatgtagatgagcttagcaaggacaggaagagcgggggcaatctttgaaatccaatgttagcgacaaaagctcgttaggatgagcagataggatgacatacagtgttccaatcaggctgaggcgtcttgccgcggcagaagttgctcagggtccaggtagcgttgcgcagcatgctcagcttccggccatcgttgatgaggttcagcagaggacgcagagcaccggcgttgagaacgaagtcacggcattgagggctgtcacccgcaatgttaccaagggcccagacggcctgctcacgaacatcgggttcagggctgctcaggagttcgcagaagatcggtacagcaccagcctcgataacgacctgggtctgttgggcggaaccagaggcaatgttggtcaaagcccaagcagcttcgaactgaacaagagtgtggggggatcggaggaattcaacgaagcggctcacgacaccggtctcgatgacacgctcaatgggggggttgcgctccttggagagcaatttcctgaacttggtggtggcttggatctgctggtcgatctgatcggagaagacgcccttaaccatctcggggagctccacattaagctagaaaaccatccattagctattttgcacagtaatgaatacatcttggctgagcgcgaagggagtcttgatgatgctggtcgtgtgcttgtccagtcagagccgaatgagggctcgcccggcggcaaagcggtgaaaagctctcgctgggacgcatctggacaagcaagagcgaccagaaagaaagattcgaaaacgggcagccgatgggcccagctcccggtcgggaaaggaacaaagagatcgaacaatgagatacaaacaaaaaagaaatgcaggaactgcatacctcactctcgatggcgctggcctcatcatcactctcggcagctacgccgccgcccacgccaatgccgccatcgcgggtctggatacctctcctcttggccaaattctcatctctcttctgctttctgatctcaacctgttgttcctcacgacgacgacgaagctcgtcaggccggaactggttccgggccttgaactgagtgcgacgatgttcggggatatagcgctcggccatggttgcttgggacacagaggggtgaaaacaaagcgcaccacaaccgggtggattagcttaagagatgaggagagaaaaagagtggggggaaagaagaaggtgagatagatagcaagatgtgggagatgggaatcccagcgagctaaataaggggatagagaaagaggctagacaaaggaagaaaggacaagcgcaaagctgagatggtagaaggaggggaaaaaagtgttgatgctcttcggaggtgggattgcccagtcacgggacgccgctgatttgctgttttcgtccagctccgcccgcaagcgccacttccgcctaagcgaagttggcgcggacttgtctcttactttttcctttcaacgcctctgcgtgtttctctaatctatactgtatcagactcatcgagaaaccttctgacgctgttctggaaaaagctgtcttgctagccatttctaattcgggcctttctggtggatgcattgtttacgtgtattactactaattgctccacccggtcccgcgtcgatctattcgcggttcgatcaacaatactacttctagtaatttctctatctatatcaatagccaaggaggtccgaactcacggcgtctcaatcttgcattggatgcattagatgcatcaggctctgttctaccgtggcatcactatgcattgtgcgacataacgtaattttacaccatgtcaggcggctatgcctcccggttcgtggatgtgtccaccgcactctctacgcagggcaaagtaagtgtcattggcgtcgtagtcgacgtcttcggcggaatatggaagtctagaggctcgtccagctgtattaccttcaccatcaaggactcaggtcttgacaacggacatacatgggacgggttgaaaatcaaatatttcaaagacaatgagagccatttacctcccgtccaactacgcgacgtgatcctgatacgagatctgtgggttcgtgaggcaagacttgaccccttcctcggtgacagactgacgctttgactgcagataaggaacttcaaaggagacccgttgggagtcgctgcccaggacagagaagtaccatgggcaatctttcgcctggacccggatcccacgtctagccctgcgcccctttgtggccctacgcactttgagccatctccttcagagaagatacatgctttgaatttgttgaatagcctcactgcagtcgatggttttcgcaaagctccagcacaagatactccacgtggctcctatattgtccaggctgcaattccaaattccaaaccttacccgcacaagaggctttctcttgtcaaggatattgtagagcgaaattatgttgacctcgtggggcaaattgtcaaggtctataccaacgacagtgaaaaggtcgtcctctatttcaccgattacacggccaacgatggtctcgaagaccgccaaataaacgatgccggtgacaatgactttggcactgaaggagatatctacggttaccaaaaacgacccaagaagaaatggacaggaccagttggacggatgaccctcacaatcacactctgggaaccccatgcatcctatgcgcgccaacatctgaaggataacgatctcatccagctatacaatgtgcatgtcaagcgcagtcgcatcaatgggatattagaagccagtatccacacaaaccgcacgaatccaaattcagtcaatgtacacaccctggatcgtcgcaaagacacgtttgtcgaacaatttctgcagcgtaggacggaatactggaaagcgaatcctcggaagcgggaactcgaaaacgaaggccagcaggtttcgaagaaaagcaccaagaaacagcgaaagaaagccgaaaaggtggaagaaggccaagttcccataacagcagcaagcagcaagcgatatgcgccaaatgaaaacagtaagtcatgccgtcttagtaataaccactggggcatcttacagttgattaacagtctatgatagtcatagcaggcagcccgtccgtccctacaatgtccctggaagcgatcctttccaacaaacttcatgacaacatctcatatgacaacatacagtaccgcttcccctttcaaaacttctgctaccgaaccacagtccgcgtggtcgatttcttccccccacgactggaagacttctccgtccccgaagactcctcgggtgagggtacctctcaaagagatcccgatcgtttcattagatgggaatggcgcttctgtctgctcgtggagagcgtccctcctccacccgcaggtcaagcgaaagaacagatgaggttgtttgtagctggcccaaatgcagagtatctattagggctgactgcagttgagtaagtcatctcggctccctcacatatcgacactaagatcgccgtgaggtcgattatctaaccataactcttcctatgtccattagtctaagacaaaaccaaaccgatctgaaagaactccgagaaaagctcttcatcttatggggagacctcgaggagcgcaaaagagcggccctacacgatggcaaacaggacctcggcccagtttcatgcaggcctttcaattgctgcattcaagagtatggtgttctttgcagacatcgttctgatactgagaacaccaacactaataatgaagatgatgagaatggctgtagccatgatgactgctttggatgggagaggcgcttttctatgttccttactactatttcctaatacattgttgcaaagcggcttctgggagtatgtgatgttgtctgcttttgtatacataggggattttgttttgcttttggcgccatggtcatcggaggactcgagtcttggggacacttgtatacaaatttgaaagatttctgctcccaaccctgcggtgatgcacagcaacagtaacactgaatgattataaaaaactagagtccgaatatggtaatattatcgataaagtaagatatagaatgacttggatatcgaaagcggctaaggggtcggcaaaagtgtcatattgatagcaatctcacagattaagtaacgaagctagggatattcatatatgtaccatacgcgagggagtggaaaaccaaaagtaggaagcacgccagcaaacaggaatatcgatgttaatgggccagaaacttgtgaagagagtccaatcttatctgcgcgaagtcattacaaaggccaaaggaaaacacaacttttgtggctagagcaatgcaggttctgtctcgcgctgcaaacttgaaaagaggtaatggcgttcgcttccccaactattatatccataatattagaccttagttaatttaacgatattggtgtcgatgccatgggcggcaggatcaaatcgacaattcgaaccccagtaacagtcccttttcccgggttctgcatgagggcatcgatgcccatatgtacattccggatcatcgcattctaatccgtatcggcagggggtcatgcgggcgatggcggacaagattgaaagttcatttttggtcaacttgcgcgagtggtcgtgctgacagttatcaactgtacattctcctagaaggtaatgaaggttgcataatttcagtttcttgaggcggttcagttcttctcgtggtatgcttttaaagtcaactcggtctacacgttgaccgtacttgtttcgttcaacgatcttgggccgtgcgggtgtagctgatttcgactgtaccacttggaactctccagggcttgacggccttgcagacgtggaagacagcgatgtactggcgtttgttgacgtgctagtcgaggttcgtgacagtggcactgcgcctggtttcggtgatggggtgagagcgggaggaggtttggacgccactgcggctttccatggggcccagacaggtgttatttttgtatttcggagaatttccggaaactgagagactctgtatgcggccttgattttggctaggtccttttcaaaggtgacgccctcgatcaaggttactcttcctacaaggtcaatgtcttccattatatccaccaaaatctgggcatatgcactggtgtcggcgcatcctaagaagatttgatgacagtgacagttatataggttgaccctgaaggcctctgaagacggcgagcagtaggtcagcgcatcgttgtaagttgaataccaatgtaagtgctttggacaagagcctcgatgcgtacctgcgatcttatcatgtgcgttgtccagtccagtatccacaaggtcaaatagtggatggccattgttgaagcccctagcaaagccctcgactgatgatgggtcggtgctaatgacgcctcggacacacatctcactcaggccctttaagttgacgtacatccttgcgattatctttgaagcatcaaggcctgggaaattgctggcaacatagtcttttagggcgacagcaagcttcttggctgcaatctttccaccttcttctcccttttgtaaaaattcatctctgaagatgatgccagttccatctagtagcacaactatgaagggctcgcggtcctaaaagcggacgagcatcgttagcacagaccaggctgcggaactataaaggtcccaccattatggccttgatcctcgcgatatgctgcattaactccatttcatgaagctggatatcacgattaaaccgcgtttcacgttcatgatcgagtttctcttgctggaaggctgcctccaactctgtcacacgctgcaaaagttcctaggtgcagggagtgtaacgtcaacatggagcacttgatactgtgatgctgagcggctacctcgattaggatattcttatcttgttctatagaagccagctgtttatatcgctcgagatactccggcgctgtcatgatgaactagataaggttcgagcactaagggacttagaggagggaagtgagagagcgatcttgggaagctcaaggctatagaagcaccgagaatggggagggtgatggtgggcggcagagacggcggcaatcgagattatggagccaaaaagaatagtagattgggcagactgcggggagtcaatactatcgggactgagtttactgtacaatcacgaagagagtgcaagatctacagagacaggtgaactgggctggcacaagcctagagcaagtcaccatcaaaacagccgcatgaggcgccaaccagtcacgagccgccggccggggagaactggggctgagtcagcccgccgcatggggaaccatcccagccaacctgaggcagtattgaggctacgtggagaaattgccagttccccttctctttcttactgcttctcctctcccacttacttacttctctcttcctttccatccacctctggtccgatcgcctcttcgatctttctcttctccacccttctccccctccctcctcaccctcaccctttctcttctcgtcctcaattcccggttcattcacaatgggtcgctttggtttcttgtccctggctctcctttctgtccaggccttgattggcggcagtctcgcggcggtacgttccctctcgcgtgactcccatcgtcccactgtcaattgagttgctgacgcgatgtcgcatgttactaggatgctgctgagaaggaggatctccctgaaacccaattgctttctgtcacggcccacgcctccttccctgcctccgagatctttggtgtcaagcttgtcaatggctacccgaccgaggcgctgatcactttcgccaatgaggaggaatctcccgtgactgtgaacttcattggtggttccttgtcggcagttgaaggagaaagcagccagattgttcgcaacctgactgcgcaccgttacagcgttgagatcccggccggtcagcaggagagcgtcagctacagcttcgccaccgaaatgcacccccaggatttgctgctcaccctcgcttccgtcatctctgataccgatggcaacctcttcactctctacgcctacaacggcactgtcagcgttgttgagccggagaccagcatctttgaccctcagatgtaaggcacttttctcacagctcgccgataaggccaagctaaccctattgttattagcctcttcctgtacttcttcctcctggcttgcttctctggcgtcgtctacttcttctacaccgtctggatcgctccctacttcccccagaagcgccgcgctggaaagggccccgagtacaagaagtccgctggtgcctccaagaaggaggcccccgttgaggctcccagcagccctgctgtctcgtctgccactacctacaacgccgagtggatccccgctcaccacatcaaccgtcctgaggccaggaaggtcaagggtagcgccaaggctaagaaccgtgcctaaatggcccttgcagtgctgagtcgatgggtgatctgtgaggagatattgggaagggcttggagtcggagggaaccttggttggttctctcagcgactctggagtaaggctagcggacttgggaaagggtcactgaaaatgtggcccaccaggagttattgctgccttggatttgcgtgtacatttacttcaaattgatatttataatcggagctcacgcaatcagccaagggggactgcatggtcggttccccgcatcactccatcaagtatcatttgaagctcaagaagaaatggcagaacgtgcctctagccccctttcgcttataccgtcctgcatcatgcgggtagtcatgcgcctcacagctttctccatgcatcaaactcctcctttaaatgtagcttcaactcggcgaatttgttcccaaattgcttcccacagcgccaacagacaaaatccctgcgcaggtagccttgttcatcgggatgcctccgcacatcatccggcgccagtgggaaatcatcaattttgacgaaaaacggtgtagaaaagctattgtaatgtttcctatgcttgagacgatcgctgaaccgatccacggagataacgtgcacatgcaagtgattcatggagggatgcgcatgaattccacacatgatctcttgctcccagttcctccccggcggcagctcctccagcggtggttctacattcagggcctcctgtctttccttatcctgcgccgagtatttcccatgtattcgtctgagctcaccagccgcgagtttgcggagcttctgcgtttcccttttcacttgtgccaggaagtcggcgtcctcgaaggcttcgaatggatggaggcgcgttttctgaggatctcgtgggagaagtaggaggtggagggttgccttggggaacatgtcgtgaatgacgacgaaatcatcgtcgtagtatactactacgttggaggggaaggtttctggtttcgcgatgtagacgcctaggccgtctcgggggccaccgatggctcgccttttcgaggtagtaggagtgtgtttggaggtgctaggatcgccatgtttgggatgtttaggtttcggagcaagtagttctgtaactgagataggaataatcagttagtggttcctgcgtctggtatgcaaggggagggagaggggtgaatcggtgtttgtgttcggagcgtacaggcgtctcttttcgctggcttgggcggtggctgctgcgcttctgcgggcgcgacatcctgttctgtggggctgtcgagctccagagttggagagtcagccatcgtagtaatgattctagctgacgagcacagcgagtgaccggtgcagagctgttatgggtgagattcagagctcttacttatgatgcggagaggccgaagccatgcgatgcgatcagcggcgactccccgcagccctacccaaaggatcaaagcggcctagtgcgggacaagccaaccgcggaatcgtctcagaaactcccgctgcttcttttcaataccaggagtgctctaggtacctttttggattctcctcaacggcctgagttgctccacgggcgtctgctctagattacctgcaactttggaattatggcccccaagaaaaagaacgacgcccgtggaggagcccccaaaccggggaccaaatcagccaaagccgccgccgaacgatcggcggagacagcgaagaaagcgcaggcttccacggaggagcctaagaaaccctctgtgaaggaggtcatcggaggcgcatcatggaccggaaaactgccggtcaatatgctcgcggagcattgccagaagcagaagtgggagaaacctgagtatacaatggtacggccaatggtggcctatcttcgtttgattcactacttaatgaattgcgaagtcattatgctgacaataccaccgcaatgcagataaaagtttcagagggctttgtttcctccgtcatcttgaagcgcgtcgatcctaagactcgagaaactgtcgtactccctcctatgaagccacccccgtcccacaagcatctcgctgcgcaacctacggcattagaggcgcgccatttcgcagctgcttatgccctatttcgagtgtgtaacatgaaaaatctacatatgatgcttccgcctacctataagaagctctggaaagaggacttcacggagatcaagacggcagataccaagggagggaaaggatggatgtacgaggcagatccgttccttgccaagcaggagcgagaaagtgcagctgcagacctggaaaagaagcggaaagagcgcgagaagatgcaggcgaaggaggcagagaagacggttgacttgggactgggctctagcggtgataacaggggcaagaagatctggtcgcaagcaccaaaagttgatcttgggggtaaagtgcgccgtgagatcgagggcattctgcgtcagcatgccatttggaatccttacaatgtggagatacccgcaagcgagcgcaagtctattgtcgaggagctcactcacttgggcttccggcgcagccatgtggaggaggcgacaagtacatgcaaggaccgggaggaggtcctggaatggcttcttatatatgtcccggaagatgatcttccacggtggtgtctacctgaagggtactccgccggtgtgagccttgccagcgatgatcttgcaagggaggccaaaatcaaacggcttgcctccatcggctaccctgctgacctgtgctcgcgaacactggatagcaaaaagggcgatgaacttgcggcagcagagttccttcagagcacgctggtgcacggatcaaattctgctatcgactcttcgcccattgcggaagaggatttgtgggcagaagagcaagataccctggaggctatcttcggagaacggtacaagcggatttcgcctaaagtctgtgaaattaagagtgaagggtcagacttgccggagtctttaacgttccgtttccagaggccttctacgcattatccttcagctgttccggttatctctattctggccaagggcattccagcttacatacgactgagtgctatacgccaggtggtacagtactctgaggagaacttttttggtgagccaatgatattcaatatcctggactggttagaggtgcatctgccggaagttatggagaacccagggcgtctgcgggatatttcaaccgtctctgcttctccaactgcgacagggtctgtatctcaactccctgttcgccaatcacgcaagaagggcagagacgttaactggcagccgggctcgccgcaaagcgtcgcgctgagagaagcctgggaagcgaagcaggcaaccaagacccagcaagagatgactcgaaaacgacaagctcttccagcctggaacacacaggacgctattattcaggccgtgaacaagtaccaagttacaatcatctctggagagaccggtagtggaaagagtacccagtccgtccagtttttgcttgatgacttgatcaagcgagaccttggtgctgccgcaaacatcatctgtacccagcctcgcagaatctctgctttgggtctggcagatcgcgtgtccgatgagcgatgtgcgtcggttggtgacgaggtgggatacatcattcgaggcgagtcgaaggccaaggcaggcacaacgaagatcacatttgttaccactggtgttctgctccgtcgcatgcaatctggcagtggccctgacggcaatgtcgcaagctccctcgcggatgtcacccacgtcgtggtggatgaagtgcacgaacggagtctcgacaccgattttcttctggctctgctgagagacgtcctccgctatcgtaaagacatcaaggtcattctcatgagtgccactctcgacgcagacatcttcatgaactattttggcggtagcaagtccgttggatttgttaacatcccaggacggaccttccccgtgcaagacaactacttggacgatatcatccgcgacacaggattctaccctgagttctccgaacgcgactatgaggaagaagacgccgtatcatctgcccaagccgacgagtcccttggcaaggttcttcgcagtctcggaatgggcatcaactacgaattgatcgcttccacagttcgatacattgacgcccagctaggcgaccagccaggaggcatcctaatcttccttcccggaacaatggagatcgagagatgcctgaacgctgtgaagagaatacccaacgcccatcccctccctcttcacgcatctctcctcccagctgaacaacggcgtgtcttcctcagccctcccaagggcaagcgcaaggtcatcgcagcgaccaacgtcgccgaaacatccatcacaatcgaggatatcgtagccgtcatcgacaccggtcgagtcaaggagacaagctacgacccccgagacaacatcgtccgactgcaagaagtatgggcctcccaggcagcctgcaagcaacgacgtggtcgagccggtcgtgtccgagccggtatatgctacaaactatatacccgcaaagcagaggcaaacatggcacagcgtccagaccccgagattcgtcgagtacccctcgaacagctctgtctatccgtcaaagccatgcagggcatcaacgacgtcgccaccttcctagccaacaccatcactccaccagaaagcaccgccgtcgaaggagccctcgacttcctgcaccgcgtcggcgctctcgaccacgacaaactaaccgccttgggccgctacctctccatgatcccagcggatctccgctgcgcaaaactcatggtctacggctccatcttcagctgcatcgacgcctgcgtcaccatctccgccatcctgaccgccaagagccccttcgtctccccgcgcgagaaacgcgaagaggccaacgccgcaaaagcctccttctccaaaggcgccgacggcgaccttctcactgatctcctcgcctaccaacagtggtccgaccgcgtcaacgcccaaggctactggcaaacccaatcctggtgctccgccaacttcctctcccatcaaaccctccgcgacatctcctccaacaaatcccaactcctaacctccctcaaagacgccggcctcctccctgtcgactactcttcctccgacccatcatctcgctggaaccgcaacgcatccaacaaacccctcctccgcgccctaatcgccggcgcctttcagcctcagattgcgcaaatctccttcccagacaagaaattcgccagctccgtcacgggaaccgtggaaatcgacccagacgcacgaacaatcaaatacttcaaccaggagaatggccgcgtcttcattcatccttcttccgtctgcttctcggcccaatcataccccagctcatctgcatatctcagctactttaccaaaatggcgacgagtaaggtgtttgttcgtgatttgacacgtaagttattatcccttatctcgatcatcccttcactatacatctgtaccctgtgagaaatgtatactaacaaagaatggtatatagcattcaacgcctactccctcctcctcttctgcgggtccatcgacctcgacaccgctggccgcggcttgatcgtcgacggatggttacggctgcgcggatgggctcgcatcggtgttctggtctcgaggttgcggatgatgttggatgagattattgcgatgaggattgatcagcctaatggtggtgaggatggtgagcgggctaggacggcagatcaggtggttgaggtcgtgaagaggttgattgagtttaatgggttggatcagtagattttggatggcttcagttttgggtggatgttttggttagtgaggttggggagtatatgagtatatagtagtagaggctagcaaaaagatagaggtcctgcgaagattagatgtgggtgtaattcatgataaatttgatgttcatgggcgtggatctgacttggcttgactgataggcttcggttcgaatactacgatatctagtcatctgtaactgaggctactgagatagatccaatggcattaactcctgcgtcataaacctggataataatccacagaacgatgcatacggtaatagacgaacggtaaacgtcatttccaacgaaacaaaggaaatcagagggtaatgaattatagcgatgctcaggcgagctcgctgttcgtcatgaaaatcccgtggatagcagcaatctgccgggagcgtgcaaaacaggtcgtgatagtcgagaaaagtaaaagaacacaagggcataacgacataggagagaaatgaagaaaatgtaaaggagggattgtatgaaaagacaagccatcgacccattaactcccgaacccggattgcttgcatgatttcaaccgtcgtgcaaatcattaaaagaaaagaaaaaaagaaaaagaaaagaaaagagaagagaaataatttaaaagcaaaaagaactccgtctccctgatatccgattccggtcacggcatcagttttcttgcgtgatctacatcttgcatgcacggccatagacgtcacatgtcttggtatcataaaaaaaggtaaatgagggtgtgaggaccttgatcctgggggattggcgacgtgagcttctgcgcacactcacgcctcttattttcaagtattagcagccttcgacaggcacgggctgcagggccgtgtagccagcaaaccctgaacccctgcgccgtgtcagacaatttcatgctctatatgcagaggtaaacaacaactctgggttgagtttctgtatttggtagcggttaaaagaggtcgaagatatcagcgcgagtgatttgatgagcggctatgcgcgcttccagtagtgcgctgattcaattgatgcgttgcgatcggaatgagagctatctctggtctgctccgggataatgaatccctttctcatctcgttctcgacgaacagagaagcgcgcttgtagcgtttgtcagaaaacttttcgtagatagagccatggtgcttgcgaggattctcgcagcattccaccatgagagaaatgagtgggagaagctgcgtgtaagtgtatccggcatagtgggcgtgggcgggagtctgtaatcatgttagaacgacttctttcgagttccagctggccaaggacatacccaggttcccttccgcagcatgagcctagccaggcagtgagcgccagcggcaacgaagctcgcggggcttccgacaaaccgctcatccatgacagtgatctccaagaagtatttggcaagcgtgcgcgtctccaagtcgtagtcgtcggccttgctaatccttcgcaggaaactcatcgggccaggccaccccagctcgaactgtaacatgctcaacatgaaacgttcagccttgagaatctcatccatcgaatatcccccatctaccatgtagacgatctcctgcacagacgggcagttgatctcctcatatttggcagcgatgaagatggcagtggcacccacgagctgaagtttgccaagggacacgatcttgcaagaaaggaaacggtcgatgtagttgacacacagaaagagggtctcgggaagcaaagagaaccgatagtggacctgcacgacccagtccataagcacagaccgcatagaccattggatctctgcttggttatccatgtagtgagcgttgggcagcatcttgatctgtaggcagtgtaagcagctaaataatagatacagtcgggcctctcgacttagtacgtacctcttgttctctcatgtattcgaagatctcctcgctgtattccgcaaccatgcttgtatcgtaccattcatcttcaatgtcttcctcagtacgtgtggcctccacgacctgctccgcaagagctaattcgcgtcggacttgctgggtgaacttggggaacagcactgtggtggcacccccagtggtattttcgccgcgagagcggtaggagcgagcagtgatatacccatcttcctcctcgtgctcgtcctcttcatcccaatcttccggctccgactgggccggtgcatgcgaggtcgaggcagagtcacgatgagccttcgcgacgcggtgagattcagggacctcgggcgcagcggggagctcgcggggcttgggatcctcgctatgatcttggactttgcaatgatcatcgtcagcctctagtaaagctttctctgcctcatcaacttcagagtccacaatggaattctcttcggtgtcttccagaactggcttcgcctcttcgtgtgtagctgcctccttcgtagtggtccgcttcgcagctgcggacgcctgtgcaagggatgccttgttgtccccttcctctagttcggtgttggtttccttggatgtaatttcgcatttgttgttcgacggttccgacgcgtccttgaatactgtagccctcttgtttaagatctttctagtatttgcagtttgctgctgcatggcaatttgcttggaaggctcgatgggtttggcgttgggcacattgctcaagaggcctttcatgccagccatcgacatgggccgctgagctggctgcgccagactgggcttcttctcgacgatcaacgccgccttctctgcccctttggtctgtttcttgcccgccagggagatatcatcgcgacccgcgtgaattggtttagccgtgttgctgacatcgccaaaagcagcccgcttggccgcacctttgttagcgccattttggaacatggtggacaaggcaggcgtggatttgtttttctgggtaagggtcttgttggccgcgagagggaagggggcgttctcgtcaccacggacgcgaattctctggggctaatgccatacacctcgtcagctcagtgtaattaactatgttgcgacattggtgaaggggtattcggaggctaagccgtcggtgcgcgtgcagcaccgtgaacatgcatgccatgtttataagccgattgggcggctgacaggcaggaagaacatgcaatggatgataacgtacctttgcgtccatcttgaatgaagagagacaatactctgaagcctccaggaccgtgtttggggagcttggggaagggtgggtggttgtttacttctctgcgccctgcgcaggagttggtcgtcgcagctaaagttatactaaaaatgcgaccccaaacaaacacaagaccgcgccaagggctcgagcgatagcgccagtcgaccaggctttgagtgttaagattgggtgccacgagagggaggaggttggttgaaagacgacgactaacaccaatacattgacaaaaacagggcgtccagcaacgaagaaagggcaggacaaacacaagctgagtttgaactggatctcaagggcaaccaccagcattgcccgaaacggtcacttccttacttggttaccgtcaacaacactcgcgctagtcctcttcgggggttgctatggcatgcttaggtcagctgctgtttgcgctgtttgcttgctcccggaacgggtgacatcatctaacgcgtcttcccgccagcacatcaattcctttactgaccatcttttccttcaaagtaagagtataactgatgataaaaacgcattttatatcgcaggctaacttgcgattctatcccgacagttttatctgccaatacttacggttgtggtggacaatgagtgttaatatcccgccgggtccttgacgcgccgggccacacgaagccgggcttcacccaacgcgagttcacgtgacatagaacgggcgggcgggctgccatcttcgctccgggatttgacgcttgaagcggaggttggagcaaccggaatgttgaattcagcttgcgaccaaacctactatctatccaggacccccgatcgcactattgaccaggctcaccggtgtcgcatggcagggcaccgattgtctttgagcgaaacgtctcgaccaggatggggtggatgggccattcgggtcgagattccagctggaatctggtaatgccaatgatgacgggccatgataatcgcagtcccgtcaatgacttgaggaatccatgtttcctgtaggcttacagtttacatctttggcctggctttttgcgggttttttaactggcacttactttggactgatctttgggtcccgtttacacccgcgcagaatgccaacctcgccaggaagccacaagtttccccccattgtgggacgcggatccggcggtacctatcatgaggcggcgggattcataagagcgggtttgtcgatggtcgtgtgcgaaaaagtccgacctccaccggatttgccatcagtgaatcagccagtattggtggcatgtgttatgtgatggtcgcaaatttgccctgactgatcctgtggttcattgtgcattgtaaaggaagagagggagaggatggaaggatgaacactggattgctggcgaccagccgccatttgaggtgtcgcggacaaccgaacggtgaaagcggactattgaagatacgcaaagtttcggtgtgtcttttgactggcggctgaccaacaacaatagcaaacacagttagttagctagcattatgggcaaaaatatgatgactattgaagcaccggccgggctggttattgactctggagcaggccccgctttgagtgcctcaataaggaacactcccaactctctacaatcggagtgatcgcacgagacaggattgtgtttgatttaactaaagattactttggcaaacacaagaggaagaatgatagagcctaattcttgccgtaaatatatatatatatatatgaacccatcattatcatactcattaacttccttacggaatgcagcccttccagtttccccccacccggctaacggcattgttacgccagttggttgttctcagtccatcgaccatcgctcaatctcattcgatcgcttggagccaggattgtgattatgtagagaccccagtgcaacgcgcaagacatcgttaaaccgcggattggcagtcaaggaaccctccgagggtttagttcacaggccgctgcgaagtcgcactggaccttgcagacatgggaatggccggcctggcagattgcgatttaaggacccgcgggactggaagccaaaggactgtccgtaggatttggaggtgctcggatgatgagagtatctagtagctgtcagtcaattcagtctggtcgcaaagaatttcagtcttgtgcctgcccgaaagttggtgaacgaacgacggggatccttacgtagcccaccgttttccgaggaggggtaaaaggacgagtctggacaggcgcagatcatgaaacgaggcaacaattgggcgttgttgctcgtcggcttgttggctctctgtcgttgcagcgccctggcccaatgaatctcaatcttcctgtctccatcccccggtagtgatggttggtgaggttggattgctctcccctcattcattgcatgctgttccgttgtttccttttctttttctttagtgatgatgacctggttgtttctccgggattctgtgctggcgatgccagaatactactaactaactactactactatagtagtcgtactactagtctacctactggcgatggatgatgagcctgaggccatcgatggaggacatttgcgccgtaggagaattccttctccccaatatggggatccggagcatcgatcgcccttcaaccggttattccaaaccatgcatgtcttacgccccgcgagtaatgaatggcagcattcagcattgagcatgggaggaaccttgcgcgaccagcgtgagggaattggtcgccgcgagagggggacaagttctttccggagacagttggtcggtcgtctttaattgcgtcctttgcccaccacgtagggaaaaagggaaccaaccttattccaggatacattcttcggatcttttcgctgcttgtttggtctgtaattataactcagctgttttaaacatttgctacgagatattcactttatcattctgctacaaaagtccaccttctgagggagttaaacccgaaatggggaccgacatgaagaaagcgtccatcactcgctctccgcagccgggatgtgatcgggggtgtcattcgacgtggccgcgctgaggaagtgccagccaaccttgaccctacgccactccgcttcatctggtcaaccgtctcgtccgttgggtgcacaaagaattaaatgggagcaataataataataatgatcctaatccacaggtgattctcttttccgtgtttctgtaatgtctgtagattggtatttcaaaagtactctgcacctgttctgtggtcgcagatcgacgatgtcgccgtcgtttgcgccaacacccggccgatactccagaatcccaaagcattttgcaccgaccctacaccccattactggcattttttggaataaaagttacagcattataaaagtgtagttttagcgattcatctgacaggtactttgtatgttattttctgccagaagaccttcaaggcagagtcgccgatctcgtagatccagatagaagccggtccgttcggacgcaatgcgatttaggattttgcgatgaaagaaagcaacgcgcaagtaaaaaaacaggctagatagagaatatagagaatcaattcgcatctgaaaggaagtcgggggatgtctgtggggggaaaagggtgcattcaagaggatggattgtcaccgacccaggccacctctgctcgctttgggtgaaaccacatccatccatccatccagcgcccactccctcttcctctctctctctctccctcctcaaccttctcttcgacccaacccgacttcttctcgcccattctcttgaccattttccttcgaaattttggtgcatatcgatcaggtaggttcctgtccatcgttcaacatgactttgatctttctttgcacctgctttccccctttcctggccttttggttctcctgactcgcttcggctctgcgtgatgccaccgctgacatacccaagcgcttggtagaacgactcacctcccacggcccacccctcttcctacatcctcaaccaccatcgctatccttcctttctcatcttgtcggatccgatattcgggtgcgactctaaataactaggtttgatttcccatcggtacgtctttgatgctctccatcgtcttccgagtgtttcgggtcgtttctcctcccaatctgcaatccatcaggattcgactagggaggtctcggcgtcatcgaatcaacttggattcccttctccagacatcttcctttctcattgacatcttttgcatcacatcgtgctgactttcgtggtggtggctgtccaggttttcgaccgtctttttctttgcctttcccgtcgctctcggctcttgcgactgaggtgccgtcgtcctcccaccgaccaccctctgcatcgccatccaacatatccataaaaactgtcgcgggtagtccatctatcaactgaacccctctggtttctctgttgtggtaggtttggatggaaattgcccataccctcctcttccccgtctctgcctgtttcctttccccccacccaccctcttgtctcttctcgcccggaccgctcttcctccccgagttcgaacacccgattgattcatacatcaatgtagtagcagtgtggtagtgcctcctttcagactctcccaccatgcaggctgtccagtacgaacagcatgctgcccctggggagtcgcctgcctacaccgaccatcgtgcgccgcctcaggaaccctccccccggagctcggttcctaagaacgtcgcctttgagctacttctcgatgagaactccaaggtccgggcccgcatacctatgcgggtacagatctaccctcatgacacaacggattccattgtgactacggttaagaatttttacggcatctacgatggtgctgcgagcggtgtcagcttcgaagacgagcaaggcattaccctcattgccaggtatgagaatctacggaacaacatgactgtttatgtgcgggttattcccgtccaggcatacacagagggctacggtgatcgcttttatgggcaccttcccgccgaggctcgcaagcgtcccagcttaggggagcccttccagatgccgccggcaatgccgccggcgcaggtcttggaacacgcccaaccaccttctcgcccggcgtcgcggctggctcggaaacgcagtgtatccccgtctggtcgcagccgtcgtagcgcatctcagaacaagcagtcatctcgggtaggcaacaagagtagaggctcgagcactcatggcagcttccacgaggagggtactcctggttatagcgatagcgagggtggctactctgggacgaagaagtcccgaaccgagcagtttggcagctcagatatcagcatggaaaacatccttcaagatggccgccggaaacggcccaagtttgaaagttcggttcgtggcgggcatcttttctttccccgtctctgttgaaacaatatttactaacgttgagtctttgtctcctttcaggaattgcctttgttcgtccctccccaggtcccgctcacaacctccacgtcgtcgatctcgccccagcgccggtcaatcggtcaggaaggggccatctcacctttcgcacgccccacccagcgcccttacaaccaacaaccattgccgtctccacagagctatggatacaatgagcagatctatagcgtcaatccggtgcgcaatccggtgtacgccacccctgtggttcctgagcatggccaccggctgcgcgaccgaaccactacccagtcctctggtgggcagtatagcaaccaggctggtcgaggcggcggcccgggcatcctccccaccccagatcctaccattgccagctgcatttccgacgaggatgttgctatgcaactgattcgtctgggagacgcatctaatttctcgcatggccgtacttctgcctccacacttgatgatgccttcagcggtgccgctgatgctgcatcctcgacgggtgcaaccagcgatggtgatgactacagcgatgatgacgatgatctacccgctcggtccaagcagcggctcgactccagccccatgctcccacctggtgccaccaagcgcacacacaagcatctggacgatatccttcccagctttgacagctctgatggaagctacgacggttacgacgaggaataccaacatgaagagttgaacgacaccttggtgaggcatgatatggatgaggatactctctaccgggacgctcccaagtccaagaaggctaagactcggcccacccatgctgtcagcaccaccaaggcgcgcgggcccaagccagcacccgtgcgtccgaataagagcagcaagccagcggccaatggggccgctcgtaaagtcaaggcgacgtctaccacggtggctcagaagacggcggtatcaccgcagatgatgagccctgtgccggtccgcaaaacatcgacttcttccgtcaacttccagcaccagctcgccgccgacgaagaggacttgtcgactaagccgcgttgccagcgatgccgtaagagcaagaagggctgcgatcggcagcgcccttgcggccgatgcaaggatgctggtatcggcattgaagggtgcatcagcgaagacgaaggaaacggtcgcaaaggccgctacggtcgtcacatgggggtccctgtcaagaaagcattcgacgccactacgaacggagtcgagacgcaatccattgtggccgctattccggtgaccacggcggctagcatggacaagaacaagaagcgcaagcgttagctggattccaatcccagcaatgaggatggctgtgcctggcccatgacctccatctccttttttctttttcgcccacaccgttcgtaccgaaccatcgatgagctgcgcctggatggctgcatttctcctgaaatattacaccttttaacatagacgaatcgacattcttccgtgcatcgtatccttcccctccttaacgagattttccacgcggaccgttggcttgatcatcttgaaactctccgaatctccctatcacactactgaatacttcttcctctccctcgagccggcctgcctcttgggatgtccttccttcatcactagcggattcgtacacgacgtctctctttgtacctcacatcgaagtcacgagtgccgcgctcccttcattctctctctacacctctctctcctcggatcgccaacctagttcgcattaccgtctgcattctgcctggcctgttatttatcatggatagtctagcgattgagctgagcgggttgattgagcttcctgagttgtgtcttttggcgttagttgctgcaatgttttcgcggccacggtccggggtcgcctccactcacttaggcccccattgaaagagcggatgtatctggattacttggttgtgttttgaatggctttgctggtgcccgtctgatttcaactggagatgagttacaacttgcaaagaggtctagtgtgatcaataggaaatatatattgaatttcaaagacagcccaggtaactcaatgaatggctagctttctaacaactactagtaacaggcttattgctatactggtctgaatagacccattgttcaagactgactcaatgcgatccatcataatgattcagtgaatggctgccattaattgagagaattattgatgaacatctgaggtgatgtccggatcgggttagcgccggctgactggcgttgccccgcattagcggcctgaggcgcgaacttcctttttttctccaacgccgagcgggcgcggatcctgccaaaaagttccgtatcttcttcatcttcactcgacttcatcatccaattctcccctcctctccctcccttttctgtttacccttcctctctctacccccggacgagctaccccctacatacccctccagcttgttctcactccgaactacttccgacgctatcaaccccaacctctctaccgcactcatactctgatcatccacacatccacccatcatgcctccgaaaggtgctccccgacgaggagcaccggccggcgcagccagccgcgccaatgcatctacaaccgcctccgcgagtcccgcgcccagcgccaccaccacgggcgactcccagactccaacacccggcccatcagcctccgggcgagcccccgtccagcgccttcaatcgctcaagaaacgcacaccctccggcagcatcggaccggccgcgaaaccccccggcgcgcccgctgcgcccggcgaacctgccaagcccacactcaaatacaagccgcgcgccgtcggccgtcgcagcaaggaggagcgagaagccatcgagaagctcgaagccgagcggcaccgcgagcgcctgaaggaggcggcggcgattcagcgcggccgggatcaaggcggtcctggtggtcgcggtgggtttgggcgcgggcgtggcggacctttggggtctgcgggcgggccattgggctcggggatgtctgggcgtcggggtagaggaggacggtttggacaggattcgagacattcgtctatgtcgagacgcagtcggtcggtcattgatctgggaaatacggcggcgggtgcggggacgcgcgattactcgtcggatgagagtgatggcgaggtgcgcatcagtattgaccagatcaatttggatagtgatgaggaggatcaggagcagatgatggtcgatagcaagaaggggaaggcggcggttaagtatgccgatgctgagaaggggttacggcctattcgcgtcgagagacatgagcatgaggagcgcgtggtcagtgtcaatatggagtcgagctcgagcaagtcggcggagctgagggagaaggctaaggcgcaggcgaaggaggatgatggtgcgctctttgtgcagcagaatgatgatgatgctgcggctactacggaaggagagcccaaggtcaagtctgagcctacggatgatgatgatcaggtcatgacagatgttccgcatgccgaggagccagctacgacggatgatggattgctgccggtacagaaggtcaaggtgcgcaggaaaatcacacccccgtcgaacgaggcgacaccccagcccgaaatggagatccctgctgccgtgaaggacccgaagagtttactacgcacgaaggaggatatcgaagagtacgagcgacacgagcaggacctggagattgtcaaggacctcttccagaaggagcccgaacctgaaaaatcggagaccaccaccccggcagagggagaggcccctgctgtggttgcgaatgaccaggacaaggacaaggacagtacaatggaggacaaggacaaggaacaggaggaagaggatgtcaacaaggacaagttggcggggcagctgttcctgatgcaattcccaccgatgacgccgaacctggtggtaccgggcaacaacgagaatccagcggatgaagctacagatgcgatggcggggcagagcgcaccggaggccagtgggtcggagcagacaggcgtcaagcgcgaagatggcgtggagatcctcgaaggtggagaggatgccacggcaacagggacgtcatccaagattgtcactgcaaccgactggggcctcagcgccgggcgcgtcggcaagctgaacgtccatgcgtcgggtcgggtgacgatggactggggaggcatcagcttcgagctggatcgcgcaacagccgtggactttctccaggaagcgttgatcgtgtcgaccccgcctaatgcagcggacgaggaattcccggatgatgaaaagaaggtgtgggcgatgggacagctgagtgggaagtttacggtgacaccggactgggggaagatgctgtaacaggatgctgtaacatgatgttgtagtaacagtgagaaggctggtcgaatgttgacagtatcccactatagatggggctgttgtgatggccttgtttatttgggaggcaggaagggatttacgtcatgcgggatggctgggggacggccgatcggatgttatgttcatactaaagacgaagataaagatagaactgtcaaaagttcagatgccaatgaggaataaccttgggatgatgtattatccacatggatggctgtgagaggtgacgacgtaagaaaggaatgccagccatgccacgccacagccattgtgtggtgttgtgttgatgttgattgccttgtgggattgattgtcgcggacagagagagagtgtgtgtgatgagcgggactataattagtacacggaccacccgagggcagtgaggcagacactgtatgtaatcaagtatgagatgccgagtaagtgatgttcgatagactttcaatgaagcatgatagatgggccgatggacggtgtaagtttgatgcgacatcccgtgttgttgagagtgatttgcacatcttcattaacgcagcttgagctcgtcattttcagggccggtgagcacaagcaaattaatgtctcacttggagttaagatagcctgatagatactgggaacaataatactgtttattactaacgtactatactagtatctatctgccctatacagagtacagtgcactatcatcccgtcccccattcacccaatagcgggaaatgaacctcgccctcgcgtggagtttctgtcatctcttattggctcacccggtccagaccctctcccaatcgggcaaaagctgatgccgatggttacagggattgtccctggttccaccgtcgcccttccctgacaagcttctgtaagtggcacgagacatcctttcaactgacgctagtcccagcccgtgctgacacggcaggatccagccaattagctgggaaatatagcgggccactgcaggctgggcaaaaccccaccaggtatctattgggggccacttgggaaagtggggctttgttcttagaagaggagaggtcggcgcaaaaacgctaaagacgaattaaatttccactaatttggcaaaagtcagggtcagggcccccccgttccagtttggcctgtcagcgtctgggccgtttcgcctgtttttccccccttcttcttttcttcttctgctttcccgtccgtccctttttctatttcctcctgttgcaactctctcttgcttgtactttatttatattgtattgtgcctgtcgttgttggagacggtcgttgctgtggttgttgctgtactattcacttgaacttacacttacacactgtcgttgccgttgcctgctctcctgtattgttcgttacaggtttcaggagatacacaccagccagtcgtttcttttgcgctctcgctcttcgcatctgtcgcgctccccgtttcagatctcgactcagcttactatcgactcgatactgtgggacttggttacttccgtttgttggtactgttgaaagtggtggattataattcctggcacgagtttttcttttggctttaatccagcacgttctggaatcccgcagccttgcttccattgtttccttccgcaccgaccttttctcgtcgcattctcgcatatccacctccacacatacatacatacattcacgatgaagacctccacgatcctcctctgtctcgctcccacgatagctctcgccgtcgaggccgatgctcaaatacctcccgctgtgtctcccacgccctccctccccaatgccaacccgcccgcgccgttgcctgagatcccgacaccgtcgaacacagagctcaatgcgaagttatgggagattcgcacgctgtttgagatcgaagataatacagatgcgacacgggtgcaagatcaactgcccgaaccagcgagtgggagaatcgcatcaacaggggaaaccaaggcgttgcgcgcacggagtgaaggcacactcggacaaacaccatggattggcatggctattggattgacctgtacggcattggcagcagtgatgctggggtgatccagacctttcttcgactttcaactcgatattcatgctgcaccaacttgcattcggagttatcttataatttcatttcacgacagtctttggcgactagactcggatcggtcgctctctgctacgagcgttgcttgcattgcattgcagcagccaccatcgaatttatggctgtgctgcagaatattcttttcgcttcttcacttcacttcttgtgaagtctgcattactttttgacctttgcattcataccatacccccatgtatagaccgggtcgttttaccttttacctttaccttacctacttctactgacgcttcttgtacgtgtacatgataccttgatttgtgccattgaggctattgtttgatgatgtatttactattaccttactactacttacacttactacttactacttaactgatcatgaatactgaatctattcattcaacttcactgctgatttcaattccgggctttgttgactgatccgggtagtacgagtgcgacaaccaatgatgatactgcgcagacagacagacagacagacaaagaacacgagcgacatgcacctgcagactgctgtcatctccgttctctattctttatctcagtgaatgggacccaaccccacaattttcaccccctcttactcctactctgactacagagtgtagtccaactccaacttgatacacgaccaacaaaacaagaacaacagtcttcccaccttcaatatctacctgggacaatctcaacacacccaactccaacaccagaaaccaccacagcgaaatcaaaatgaccaccaccacaaccacaatctcccccacaaacccccctcctactactaccagtggtaacactccacacaacatccccccctacacccccatgacctccctctcgcacgaactcggcatcctcttcggcttcctagccgcctgtttcgtcgtgatgggcgtatatgtattcttctggagaggtaacgcttaccccatacacacacacccttctcttctatcatcaaacacatactaacatcccatatctggtgcggtggtggggctaaacagcagccgaattccgctccgaacacgcccagaaactccggcggcagatgctcctcacgcggggaatccatcacgggagcggagggatcggggagaaattcaattctcaacatagccatgtgcatgatggtaggtgtttggatggaagtgcaggattggggttgcatcagaggaatattattattactcctgagaattctgcttctgctggaagtggggtgggtatgtataaggagaatgagatcggggtggcgttgactaccgggatggatgtggtttcgtcgccgagtttggggcccatgacgcctacttctacgactgtttcggcttctggtggtggtggtggtgctgctgctgggagggagattccggtgggggttggttcgattgctcctattggggggaggatgaatctggggtctaatgttggtggtgttgctggtggtggtggtaggagggatgagatggagtatggggttgagatggatgtgttggggtttttgcagcggaggtgaattttcttatctttcatctattgatctattaaccgggtggttgatcggatcattcatgtctatttacctactgctggctatctatccatctcttttcccactacataccctaagaagaagaagaagaagtcaagtagacctgctcagcgcttcacgcttcacaacctagttagtataagtatcctgctgctcagcgctccccagctagcatctacttccccatcgcaacaaacaacctatccccaatatcccccaacccgggcacaatcatcccccgctcatcacacctcgcatccaccgccccagtccacacctcgacgccctcaggccaggtccccgctgcgcgaagcacgcccgcttccgaacccagcacactcaacatgacgactctctgcacgccccattcacggagtaactggatcgctgcttctgcggtagcacccgttgcaatgacaggatcgagtaggatggctgttgcagcagcggcggtgttggtgctggaactgtcgggctggaaggggaggttgttgtagtattcgactggttggagggtgagacgttcgcggaagagaccgaggtggtagattgggatggaggtggggaggaggttatttattgctgtttattatataatcattagttatgagttgatggttttgagttgatggtcattggatgttaggaattggtcggtgagagcaggtgggtgcccgagataggaggtagtatggggggaagggacgataccctctatcatgcccaacccagaccggagaataggcaccaaagcaatgtccgagggatcaatgtcgtgagtgacgtattcggtgcctaggggagtggtgtcctattcaaataagtcaataagtctattgataaatagttgatagaggaagactcaccattcctgctttcttcaccttccatcctgctgcaaatgcttccacgcccaagatagtggctatctcgtgcaccaggctgcgggtctcgcgggtcgaggtggatgcggaccggagctgtgatagcttggcttggaggaggggatgggaagagacgtggacgttggaagggagggccatgattgattcagttggagtaatagtactaagtgaatgataaggtgaggggaagaggaagaaggatccaggagctaactatggagtacttgtaggaaccaggaacgggcatcactgcttgctgcagaagcaaagaagaggggtaaggtaagcaacaagtcacctgctctggtccagtgatctcccaaattccagtctctgcaacttccatggatttcattctccttcattgtgacttcagttcacactttcattccccgcgatggtcggcctcctttctttcctgataagcacccgcgaaccagatcccccactgatccaccgtgctggctgacccactctttcaagtctttcgattactccagcaatccagtcaacttaagccagttcaataactctacaagactgcaaacgctgaccccgccaacaagttatattttctgcgcaaattactatggtacagagaactactgataaaggtcaagcaaagcatgtgcaattaaacaattcaaaacaacgatgccaaagattaaaagcaaaacaaaatcagagcggagaacatcaacggcggggacacataaacacatcactatatcaaacgatttaacgcaatacattaagtggtcacgaaacaaagtaatagatcaaaaggtctgaacgaatgacttgaagcagaagaatgtatataacggacaaaggtatcaaagatggcctggggtaaccccaaggcaattgaccaaacacgctgatgcgcacatgtagaacggacggcactaatgattagggcgtagaagagcgtataagaagaaggcaatgaaaaaacaacaactccaccgagtgctaggatgaacacacaggaccagccgggtgtcgagatgttgccttgggaaaacaacccacaaaaacaagaaaatgaccacaccggactcccgtgagctcttgcgaaaccataacgcaatgaaagacgtcgcagaaaacaataaagcaattaactgtgagccagggaacgccagcaagcagcatgatgcggcagtccagatcatagcatcccttgggaattctctgccgccacttgctcgccgttcccgacccaatccgaaatccacccgcgacccaaatcagataaaaaaaccaatgcccgcgtaaggaatgaatgaaaacgagaatgaagatgaacttagttggtgacgtagatgaccatggtcaagctacactgtccgtcgagtagagatgttgatcgcactagtacgcggtgccaacgctggcaagcgtcttcgtcggcattgggtgaataggttggtccttggcgacgcgcaacgaatcttcgtagccgaccaaggcctgggaatgaagtttgaatgactcgcccatgagctttgtaattctgttaaggtattagcatacgatatcatagcatgagcatagtagaggatcaacttacccccaaactaccacgccgtctaggatgttaccccatacacgggccacggtggagctgagttttccaaaagcatcgacggcgtcatcatcaaacaaattccgaaccttattgtagatggccatctcagcctccgttgcgggctcttcgtcatgttccaggcgatagagccagagactgaggatgaccatcaagtccaagccgcagagaggatgctcgacgctccagttggttgccgacgtcttggcgacccagttgatgccctgaacggcggcgatctcaatgcactcaaagcacgactgaataaccttattcatctcctgagaccgcttgaccttctcgcgtgcgacagtcatcgcagcggcgacctcgtaagatgagtggtagcgcagagcctcctggatggacttgaggtcaacttccaggcgggcgcgagtgttgcggtagacggccatcgagttgaaaatcaaggggtggcccttttgaggggtgctgagaggcaccacaatcgtttccggctcgcacacttccagcgaattttcccacgtctccagcgccaagcggagcttgtattcggtcaccacgtcctggagggcctcgaagctcctcttgtggttccaaacttgcaggaaaagcgcgttgatcagcacacgggtggcgaaagcactgtagcgcgtctgctcgccctggaaaaggcagtcgtgcgcttcacgaacagtaagcggcgtggaggacgctaagctgcgacgccacgcctcatcgtccgtcacatccaaattccacatggattccgaggaaggcagctccaaattgtcaaattcgtcgaagctcatcgctggagtgtggttgaaagtcagcgtgagcatgccgaagaagatgtaaacggcgtagtacgtccggcggcacgactcgtcctcgatccactcctcgcgggtcggctgagcaccctcgcgcgcttcggtccggagcttcagttgatagcggtttccggcaaccatctacaattatcagcactattcaaatagtaaaattagggggcagggatgctcttacattggccagaagactcttgatggaacaggtccattcgaggcccttgggatcaccactccagctctcaaagatcatgttcagcagggtactttgcatggcccagagagggcacttgcgagagtcaaagttgtccttgtgttgcaaaaattggttgacaagcatcttggaccccacgtgaagcatgaatgcatgctgccgctcaaaggtgtacagagcaccaatagaaaggaccgcaagtagcaatggcggtgaagtagcggtaggcttgaaagactcttggtgcaagaacggcaggtgagggtggtacagattgaagtacgttgagagatacttgttgagagacgcggtcggaggaagctggaaggtctcgggaagcacattgagagaatccacattgtgcagacgttcaacaaccatgtttcgctcgatctcgttcgcaatctgcggagccttaggcagcgtcagggcttggctaggaccaggcgaccggcggtagttcactggactaacgggaccagtcatcgagggatacggcgacagcgcattcggcgtcgagtttccagacatgggcagcgagttcaccagggagtgcagcgagggcgcaagcgcatcacccacggcgccgtgtcggtccataaccgagggcagcgtatgcgattccgagctactgtcttgagacacaaacggagatcccatcgggtgcttcgtgtcagcaggggaaaccagggtgtcccaaggcatctgcggcaaggtcgcgttgcccgacatgtacgacacaggaggctctaatagaggaccgcgtccaggggaaaaggagcgatccgattcagcacgttcattggcttgaccagtagcggcagctgcggccttatgttggaaatctgtcatcaacatggctgcagtttcaagatcaaccataccatcactgctggcctctatttgttcgagagtagcaggatcaattgtgatcgagggcttagacgggccgggggcgggggaagtcttttggacacccgcgccaccacgtcgccggccctcggaaactagcggtatcccaccgtcctttgcgtgaacggtacggtcatgacgaaggagtaaatcacggcgcacgaaagtactccggcacttcagacacttgaacggcctctccttggtatctataaagcaacaaaggttagtattgtgcctaaagactaaatgacgcgaaacacagccgtagcacagtaactagcctgcctgcacaaagacggcacacctagccccgcgcacaggaaagccgaccatatagaaagaaaaccactctacttacgcgaacgttcgtgtctgctgcgatgttcgcttctgctaaaggcgcgattacaaaattggcacttgtatttcttctctggggctgatgtcttcttggctggcgagttggtcgcctggggaggtgcagtgggagccattgctgagaatactgcagcgaatatacaaccacggctgaatcctagtagagcagcgacacgatcgaagactgcgctatcgtcccttttgtgatttcacaccggttctgtaggcgggtagacgacaggaattcggtttggtgcctgatcattccttgcgtgggggaatactggagggcagtgttgaattggaataagggaggtccagccacaggcggactaggaggggagaatagtgtgatagcgggttatggttgtagtattggtgatggttgtgtggtggaggcagtctttaataagaagccgaggaggggaagtaccaaaggatgggaaagacagaacgggaatagacaaacaatagggaaaaggaaaagaaaagaaaaaaggaagagagcaagatgttgaatgctgacccaggaaagaagaggagagagaaagaggaggagggggaagaaggaaggaggaaggcgtttgagagaagagaagaagaggaggaggaaaggaagagaaaaagaatgggtaagaggagggggggggggatgttgaatggatgaggagaaagtagtttgtgagttgcgggagagagagtcctgggaaaaaaggcctggtcgaaaggaagggagcgaggggggggagggagacttgagcagagggaaaagtggtgtgggtgtagagagaacgcgccaggacgtgggcacaagccgatgggcgattcgggcgatcgctggatcgcgacagtgaggcggtcgtgtccagcggcggtgttggcgatttgggcgacgagcggcgcagcgacaacagggaagtgggaggcgggaaagaggggctccctcggcgggactgacggagggggaaaacaagcgaacaggccagtccccggattcgaccacgcactggggcccataatgccaccgtcttcattccccgacagccaattgttttgctggtcgcccattctgactaacggcgtgcccgggctaaacggaacctggttaggacacgtccacctttccttcggtgacccatatttcgaaaagagacaaaaaagttcaggaaaataagcaaaaatgaaattgaaaattaataaaaattcaaaacaaaaatggatctaactgcaaagcgatgaataaaaatataatagaatttaaataaaataaatagaaaaatcatacaaactatctacacagctaaaagaacagacaacaaaacaaagcagtagcccagcccaccgcagcccacatgggccgtacagtagtagacttccaacccgtcaacccggttcagccggggggcctccttcgactggctgaaatcgaccgtttgttagaggtcttgggttgatgtgagggagaatcttatccactctccattttccattttgcacccactattactgctgctgaaaaaggcaaaaaatgggaaatggaaaatgtgagaaggaaaataataaaaaatgaaaaataaaataaaaaagaaaaccgaaaagaaacacaatgatctcaatatccgaaaaaatgatccgagcagaaaaaaaagaaaatttactcttcatatgcataacattgggcagcatcctacatgtttcccctggtgagttatcgagactcccgatgtgatctggatagatttggatcatgattgacatgatgattagttttgttggttggttgactccaaagtacaccgtagttagtcgtcatatcttcttgggaacattatacatcccctctcttacacagcgcacagtcgatactctcatgatcaaatatcccctgctagggttaacccactcggataatgctcctatccccatttggtgatggcgcccctcgctcacctttcagcggtcgagtgcaggaccctagaaggataataatgggccagcagagcttctacggtgtattcctgcgacttgcctaactgaccacacaaaattcatgcggacgctggatggcaggctcgactttcgattctctcccacttcccatcgatattatttcatagtggggttgggggtggaatgaggactccatacggtatggtatgtaactttgttcagtgggtacaagtggtagctcgatgggtacaatgcagtgaggaggacactggacaagacttcaggttgtcttagtaaccttgaagcggacatgactagcaccgaggaactgagtgaggttcggattacctgctgtaatcctcaatcgcagcgggtgcaagtaagatgaagaaaagccaaatggtccctatccctatcgcctatccctatgtgacagcgcagaaatcgcaaacttggtacagtcggctgcggggccgtccaagagacaggtagatactgtcattgaccattgtcagtagacaaaggtcagggcacagcattagactacaattccagtcgatgtatcttggtcattgcatgaaaatggtccacagtaattagagggaagagggtgctcgatagatgagagaggagaagggggttaaagggaacaggctcgaagaggttagactgtaagtttgcaggttgaattgagaatccatcgcagacacgcactttcactcatttcctctcacacactctctctcttttctctctcacaaaactcccgtccagccaacagattagtgccccccttcccctccgtcccctcttctgcctacaaaaattaattttttcgcccctcgtcagcccccccttgcccctccggcagggatccagcaccatccaaatgccacggagacgcactgccatcatgattcgtgtattggctcccttcatttccaccacggaatctcttcacatccaaatcaagtggtcgattcgtccaaaccgggctctcattcctcacgctgatcgtacctacgtactcatctcatccttcaataatccgcatatctatcatcaaccatcatcatccctttttctctccccatttttacttttttttcttacttcttcttctagatcatctaatgttactccatttgtatccctccgtatcccgccacccacttccttacccctctatccccctctaaactccccctccttccctcccctctttttgaagtctaacccttctttaaacccctctttggtaaatcggctcgctgggatcaccgtcggtaatccctacttatgtcgtagataacccactagttatttgataatcggccgcccgccgcaaggctggtcatgacttcatttccatacgatccaatttgtgtgagtgggattgcccgtctaactccgacgagaactagccccggtggatctttaaatcgagcgctgccgttgttccagaccccctctcttctccgttccccttcttccgtccgtcacaatgacgagtgttggttcattcgaatgtctacaaagtacaaatatagaatggttcgcgagcgcatttcacgaaccactttgcgaacacaagagcttcgcgcggcattctgtattaaatccttcatgttgccaagtcagttgaagccagatagagggcgggagatgaatcgtgtttggctgataaagccacccgtcatcacgcatcaataggagaatattgctgacgatgtgatgtctctcagtttgacagatcatcgcccagtctatcggtagcctaaagaacacacactaacatccctaaatttctggcaagcctcttggccttcattggatgtcccctggactaaataggtaaagaaaaaaaaagaaaaaggaaaacggactatctgaaaaaagaaaaagctaatcgtgcgatgcactgcgaacgccagaatgaccttgggtgaaaggtggtcagaggttcaaacatggcgcatggtttgcctcccacttcagctcagggtcagctgctccagcggccgccaacacgacagccagcgtcagcaggtgaaggaaatcaagggtcagaaacacaaccctccgtagggcgatggacgctgtttcgtttccaattcttcttgctcgcttgccaggccccatttcccctcctcttttccccctccccccaccttaacttagtactttggaaaagcaatccactggatttcggccaccgagcgtgtgggcgggctacatcaggtgtccttgttcgtgggacacaaaatactacagaattactccatcctggacgctaaatggataatgcaaaagcttgagacagcagacaaaactcatgttctggagcgatccaacctggaccttgggaagctgcaagactgcatcatccccaaacactattgtttctgtttttggcagtttggcatccaagccgaagatgcatcaacctaacaccgactacctagtcccaactgcataagtggcatggggaacccggcccttcgacagagagagttagtctgaagccagaggtaccctagggcaggttacttgtggctgcctgcacgcccgcagtcgcgcctaaccagcctcactcggagacgcgccctcgttccgcgtcgccgtcgaaaaagtaaacgatccaccttggggagggggacagattacatacgtaagtagacaaggacgtagttagctcgttagctacacagttgcaagtacaaatatgtcacggtcagatgacgctgagcgatagttccgggcctgtccttggccccttggttcgaccaccataggcaaacccggattgattggcgtttccatcctggacttggttctgagaatgatacgggaagatatttcgaccatgattttaggacagtctcagatatttctgtttcattctataccaaagaaatgatgaagcctattttcattctcaatctcagagacagtatcaccatcatcaccaccaccaccacgaaggttcccgtaaaatcccggcacgcgagtggggcatcactgggtggacctcaagaaaaccccaccagacacggttagttactagggaaacgcacatgatcatgaggggagcacaaaagtaccccaggaggatcgcatacatccgataattacggagtagatatccagaacaatgaatcagtttaatctatctttccaccgccacgaccgaggggtggtgctttggctctcactgcctgcggatcatctgggcgcattgtatcgagttaccgaggagcgtccttccaatatgcccctaagatcaatacggtcacgatcgctatcccccaaatgcatgtcactaactacagaaagaactgggatactctgactgctatcatgctagccattgattgcgataagccagagaggcgccgcttccatcatcccatgatagacagccctagaggcatcagcgattctgagtctccacccgagggatccgtccagatgcaggccccagaatcctaatcagcattagtgcctgagcaacccattcttacgtactccattctcaccgctttcatctgccaggagctcggcctgcaggaataaagcggtgagccggggcgcttacgcttttgagaaggtcggaaaaggatggacagcagaaaggtcaaatccagacactcggcctgctctcacacgtccagccgcccgaatttcgacggcctcggtttggaggtcgaaccctggcaaattcgattcgttcactatcacttctgaggtgcttgatccactttccgagccatgcagcggtccgacccagtcaacgcctcagcttgtcctgtatctcatggaaggatgttacgagcttgcaggtccaggaacgacgcgagatactcatgacgacctaccagttggtcgaaagggtgtcaacaacttgggaacaagtcgcttggggtttcatctatcaggcaatatcgagcacctgcgtacggaccatgcatcgatttcctagaccggcgcacggggtcaagagaggggggcaatagtgcaaaactcccgtacataccgatcctcccatccatgatcgatcatttccgatccaggctcgcttttctccggcgggagcgtgtcctccatacctttggtgattcggtgggttgggagtccattctcttggatatcgttcattcggttttcacacctacctgaaaacaaaaaaagggggctaaacctcaaaaaccagtctcgaaaagcgaagaaacccccttctggctttctgatttggctctttaccctgcagctacccgttctatttcctcctttgcaccaaagatgcagtcgatcaacttcgtcgcgaagggtcgatcgccggattccacaaccatggcaaatgaatcttcaattgaatttccacagggcgtctatgatccagtcaggcgcgtccaactccaccaggtaccgttgcaggaaatcaggaacctcttccccgaaaccccggcccttacactagcaagcgtcggcagccatcccaggctaggaagtggaagagaaaaagtctacttatctcggctggcgctcatcgtcccgacaactttgggactttggcggtttgcatcgaccctggtcggcggcgcccgtgatccgtccatccgtcacgtaattaggcagtagtgctccgtactaagtgcccctccatctccgaacggtctggaatatcctaggcgggcatccctggagtcggtgaaggatgtcaaccatcaccgtcttggtgccgttggggattgatcttgatccccgtggaaggattccttgaccgcttctagatactatcaggttgggcatcgcttttctacacatggcattgaaaatatggtctgctgtcatgagaggtcccacaacttcttggatgaacaacaagtttccagagcatacggagtcgaagcagaagacacgggttccaagacaaagaaaatttttgaaggagcagattctcgataatgaaagcgacccactcaatgatgaacccgctcttccagctgataagctgctccatctgtgggcaggttagtactccggaaatccgtctgacaagttttccatctatttttttctttttcctttcccttttcttcaattttctatctttcccctccaccgcagcgctccgctttccttttcctggtttgtgcgttgtgcgatgcccttccctaaccctagacctaacttcagcagttccactgacatcggcagttactttagcctggtggcaatagctgcgatggggcccgccaaatacggtagtctcttcgcgtcgcgctatcagcaaagggatgtatacactgtagtcgcctaattcggcttggttttcgatagatcttggtgtcgtagtccaggatattctaaacacgtagttgcatgcgatcggcttaaccatggaaagctatctgtcagtcggggttcgtggccgggatactggttggttccatggttcactcccgtcggttcctgatgatatacagatgctacgacacggagtccggattctgctccgtagtttatcggagacttgtgattagtggtaggagtaacttctggatatgtaggccctgtaatctggctctggatatgatcgggactatgtgatatgatgggtcgtcgtagtatattctgtgcatttctggatgccgaaatatatattgcggtagcaagcatatcccatggaacatggtttctatgagaaatactgtagtgttcctttcattcaaaccttaaccccagaaaccaaatatatagcgccgtctccatcaccagcacttgtgttactagtatactgcaaacttcccatatcaacccgcgttaattctactactcactacttcacatccatccacaaccgaacaatccgaataggagataaacatctgtttcatactaaccgcgtgtctacactattggaccaactacgtactcgcaaccaaacaaactaactttcaatatgcatcttccccgaccaaccaccaagacggacaagaacccatctctgaactcgaactctaagctaagtcaaaggaattgctccccgagccccaactaccaactatccaaacaaagccggatccaaggaagtcattggaatccataatgatagcataagtctagaacaccactacccagttcatagcctaccaatcaactgagctggaatgcacaacaggcattatcatcgtatctctacaaacaattactagactactccgtagacacagcttcccttctacaaacaaaataacataagataaacaccacagaaaaatctagaaatccctaacctatccataaacctagccgcgccccgtaatcaataaaaataacaccgtcccacccgccagccaccagagaaggaggaaaaaaagaaggctcgaaaattcttctcgaagcacccacaccatcatcaatcggatccttcgtccacatcatcctgccaaccggatgtttgggaatcaaggaaaacagtggttcctcgaatcctaccttcctaagtattgtagactaaagtgaatgcaagaaaaagggggaaacggggttaaactaactttcaagctgagactgactagtacgtggacaatggggttggattggttgaggaatgcgcggaaacgggatgtgatcagctaactaatcgggcgtactatctaagtttgtctttcttgtttttctattcatctttctacggaatacggtcgatggggagtgccgttgttgatccgagggattggttcgatttagtatgctcagttaaggagaaagtgggttggttggtgggattgatggattgatggatgatggatgatggatggatttggatgatgggcaacgttgggacctggatctggacctagattgcagttgggtggtgggtatcggagtgcccgggtatagttcctaactactccgtaactgagattaataacttttttgcactacctgtgtacctagttatcttctagcatatggaatatgattaagggaaaggtcgtcgccggaatctgggttcctgctatgctcatttccgtgtactccgtagttctagctcaactagtgtcggactcgggatctaggcagggatggatgtttcattctagtttacgaagtactctgcttactacttgaccattattgtgaatgtgtgaaatatcccttgatagaggggtatgataatcatctactacaattagtgtctgtctgagtagtagattgacagacagtatgtagtgccgtgagggggatcatctcttctctaatttcccccccctcccctggttatggtctccttgctgaatacccctcgtgatgatcagaggtttaatgtattgttgttagacatcaaatgtaattgagaagcaaggtgctaagacatttcattaattagattggtgtttgcttttaagcttaagcctgataattgttgtctcgcgggtggtgtatgatatttgtggttcgtgtagtggttcatgtgctttatttcatgtcactacgttatactactttttattttaattcaatgtagagtacaagcattgattattagagttaagtcatgctagatgctcgtgtatgtttgtatctatcaaccactgcccatatagtaactgttgtatatgtatactcagcctacaacagcctccatacggacatcatatccacgaacaacccgtatatatctattctacatactcaactcacagtaatcaccaacacgagtcaaatcgaatagtctcgtatacataccctcaccccccatctccccgtaactgccaccaccacaccatcaccacaactcactatccaacgtcagcccatcactataccacccatcccgattcttcagcccccatctctcctgcacccagaaccatctgaccccgacgacaacacccccgcaaaatatctctaatgtcgtccataagctgacaccaataattactgcctcggctgagaccctactcagataccgaggaatatcacaccaccagggtaacctcctctcttctttcttcacatgctttcatttttttcatccactcacttaatacaacacaatatcattgtgaaatgttctagaatgaataattactacgtagatgacgaatccacccgcctagtcacccgctcactcccgacaactagttaattactatagagtataagtgccgacatatctccgagcacagactgttaacctagtctggaaggtacctagagacatcggtatcagtatgaaactgactaaatcgtagtaattaggcagtgtagccaatgaatctgaagggtagtcctaactagctaagttacggtccgtctgacggtttctatagcacgtgggtgatgatgcttactttgagggattaagttgagctagtactgaagaatggatgggagactaatccatgttagtgaggatgtagtaggtaatggtggataaatgatctggctgcagattatgaccaagtatgtgcgagattgggggtggcttgattgttgctgttggctaggtatctgatcatagggggctgtatcggatttacttcctttcggggctagaaggggtgagaatagtgcctggtgttttggtattgggcgtatggattggggtaatgttgatacgacctctggatttctggatgcttggatgtttgggtatggtagtcctgtattgcttgggatataatgttgatgctttaatgttgtatgcccgtggtttttggaatataactgtttgaatacccgcatgatctgcagagttatagtgaaagaggtcatatacggactaggttgatacaccgaaggttcggaggattgtaggagaatgagcgttataaattgctggatagatgaggctacattgctcccacgatgcaaaactgatactgaggtcatggacatcattgctttgtcaccgttttatcctcatggctgttatcaccgactagccataacatggagcttctaattgaatggcattgtgtcacatgtcgacgtcagacaatcctgcatggagcatacctcactcgtttggatgaaggagcgcgtcagtcaatgtaaaaagcaaattgagatatgagatgaattgctagtgcctttgcctagatactggagtgttcgagcttgaagcatacctaggagcatatgatcaacacgaaggaataatgatccaatgcgtatcctcagtcttcccataatgagcaattggatccggaaatctggtattttataggctgacagtcaacacaaaacacactacatctctgtgtagttgcttcttgaacactctgctgatatctcctaacagacccactgccatgctcaatttacaacactcgcaaagactcaccacgcagaacagacaacctaccagtaagctcaagtctgacacttctgcagacaaccgcaccccctgcaagacagctccctggccgcagatccttctgcacgctgatatcgaaccctagtcatttcaattccgactggacttgatcgaccggtgtctgtggttattgttataaccgcagtatgtctcctactagttagaccaaaatgtccttaagcataaagccaagcatgagcgtgatccagtcataaacaggatatcgttttgagtttgttgcaggtctggtgtgaagccactgtcagaagtaaactgcgtgatcgacgtataccattaagtcctgcgtccgttagctcccaagtcatttgactttcggacgctaggtgtctaagcgttatgctgagtctttagatatgatgggtcaaattagcccagaaagtactgtgtcgtttactgtatgtcttcatgactagtcagtcagtcatacgaaagtgcatcagaaggcaactgcctgctaattagataccatacatatcatccgagaagtgggtgccaaggcaaaaagtgtcaatgcgagaatagcataaagatgagtacagtatcacttatcaggtaccatacctgttatctatatcccagtggctttgttggacacagacctcaggccctgcatttccgcggcggttggtgaacaggggttggttggttctttgacagtgcgagcatagtgaacgacaggtatctctgctgtagagatagacgatacagtagatagcatacacaggaagtcgtgttattagtctctaaacatcgtatattggtttcactatcgccagtcaagcttgagatcgccaatggcctcagcaagctatgaccgttgcagatgcacttgcagcgcgacgcgagtcaagttacgtctccacccaaaaatggggaaacgaaggcactaataagatactagtaacaagagagagagcctggaagtttaaaactctctgataggtactaaagacgagagagtgggctggggatggataagaaggttaataccacggtttaccgggacgtgcttcccatcgtctttgagcggaattggcagccgtgcgggttgagtgtggactctccttgagaagacgcggtttgagctccccttcgtcttgcccccgagacccaagactaatgtattattgactcgcggagtaaagcatctctaactgattactggtgtggtggctggaataattcagaaatttacacgcttcatcaaaaccaatgatcagcagatatatcatccttcgactctccctcctccccccctggcccagccaatctgtgacggcgagtttttggttggaccgagttactactacttacggccacggcaaagtccaccgtgcaatccagacgccttaagtaattaggttggctaaccccaaagagccccattagggtctcggaatgcgcacgtactcgcgatgtgctgccaatgatggatctggatggtacggagcgcgtagacaacatccatggttcggggaaagatgttacccagttacctacccagtcttccaatcgtagggatcgagtctgatggagtacgggtgccatccgaagcctcagaaggctcgtgctgttgctgtgctttgcttcccgcggtaagaagcggtaatctggcatacgcaccggtatttattcttcacggtgtgttctgtttgtttatcatatattaactggtctgagtgcgagattttattttattttatttttctttttcattcaaggtaagacacgagggctaggttagagaggctaatgataggctaagactgctctagatcgtttgttgggtggcgacgctggagggtgaatgagataaaaaaagaaagagaaaaagaaaacagagaaagaggaagaaactgcacatgcaagtcggacgggagcttgaccactgacgaggtctttgtacctaccttagagaagggagtgagcttggaaataatatgtgcgttgggactattgtgtgcacttgtggcagagtgcaggagtgacagacaatcaacaacagtatcagcatgcatagtttgcatacatagttagcagtaagttctaatagtgtgctcagagattctaaagtcaagccagtcagtccgttcgtcagtcagtaagtaatagtaatagtaatagtagatagttgaactcgacaagaacaatactggagtctgcttgttcctctgaacagtatctggtaacgggctggtacggtacggggcggtattgtcactccactttggactgacttgggattcccgccgaccgccagccagaaaccaataatgccaatctgcccacctcccccaaaggcaatcgtcggaacctccctaaatctccctctctctctcctggcgattgctgtcgcttcgactctcctttttcttttgctgctcctttcttttcttttcttcgatgtcaggttgaactgcccttgggttttccaagttcaagatagatggtgttctgacctcagatctgacactacctactacccccccctaactccaagaccccaagtgtgtcttatcccactcacctgccactttctgcccccccgtatctcactcgccctcttccctgccaccaccaccaccacaaccgccgctatctgtatatcactcccgcagccaattctgcaaccctctcgacttctcccccgttaaccgcccctccgcctcgcttgcttgtattctggttatttgccttctagtcatgaacaacgcctttcgttgagctcctccagccatccgttgcggggacgttagtgtgccgatcttcgattcactcctgttcgaactatcattttgttgtgatacccgatgttcgattcccgcgtggcagagccattggccgttgataccggatctgcgctggcgactaagaccaacacctatacggccactttcgagtaccccgacgaacaagtcacgacccccaccactggctcacggagccgtgcgaatagcctatccttccaacagtcctccctcaccgccaaccaatcgcccacacggcgtatctcctcaatgaagctcaccacggatgggcgctatacgcccagccccgaaccgcctccggcgctgttcgtgcgggctatgtatgattacgatgccgacgatcacaccagtctcagcttccgccgaggcgacattatacaggtattgaaccagctcgagaccggttggtgggacggtgtcatcgacaatagtgtgcggggctggttccccagtaactactgcactgtgataacagacttgggcgagcttgaagaacagggaccgcagacccacgagaatgaggaagttagtgcggagtcaggcattggcgaggaatacgaggaggaacaagacggtgatgatgttgactcagcgggcaatccgcgcgactcgcagcccattctgcctatcgagggcgtaggagctcccaaggagcaggaggaggcagccttctggatcccacaggcgacacctgatggccgtctattctatttcaacacccttaccggctacagtaccatggaacttccgttcgaaaatcccgctgtcaacgagactggcccttatgaccgcaacaacttcctcgtgcccgaccagacgcgacctcctccggagctgatggctcgtgggttcgaacgggacgaggatgattacgatggctcagcttcggaagcggaaggcgagtccttgatgcttacatctcgcgattccatgtctcggagacgccagtcctacttggacggagtttcacccgcgacgtccatggactcgctgcacccaccatctgcgacaaagtccatcaacgacggaaaaagttcgcatcagtcccttctgacatcgcacaagttctatgattctgccacgagcagtaacaactccgtctccgataatatccacaggccttccgtctcctctgaagttccgtcgcatttcgttgacgacgggttctctgttcagttgacctggcctctgcttgttgacaatatgcgccatgccgttgaggtctaccggcaaacgctgttgaacggcgaccgctctgagtatgtgaggaaagcggaggatatttccgaccatctgcgcatgctgctggcggctggctcggacacgaccgacaatcactccggaaacccatcagtgatctccaccaacaaggcgctatatccccacttcagggatatgatgtcaaaattctcgaagctcgtgctctcgtcccacattgcggccgccgattggccaggaccggattccatcaataaatgcttgcaagaggcagatggtgtgatgcagggcgtctacggctacgtcgaggttgcaagacaacagcgtggcgagaccatccatcgcattgttcctggattcgtcgtgggcagcttttcgggcggctgctggcagaataatggcgtctctcttagtgattcgggtccgacttcgtttctggatcacgacgcaaatgattcgcgggcggagccatcagtgaccctggatgcggcccttatagaccacattgatattctcaggagatcctttgttggcagcattcgtcggctggaagagcgactgacacttaaccagaagaagattgttaccattaaagagcacgaggaaattgcgaatgctgtttctcttgctgcaatcaaggtcgttgagcagttccgcccgtggatgtcggcagttgaatctattaacctagcacccctcgggactagcttccaaaatccacaactggttgatttcagcttgcaaaagcaaagaacctacgatgccattgccgacttcgtactcagctgtcaagccgtttcggcgccactgggcgatgaatgggcagaactacgaggtaattcgcttgatgaccgattgaatgccgtgcgtggcgttcaccggcagcttgagaactatgtttcccaaatcggcttctccctttcactgctcctcgaacaagtgcccgaaccttctgccttccgcgcggaaagtcgcctgggtggggagaatgcggggctgaaggccattcacagcaggtcggagtcccaagctggagtcgccaccgagtccattggtattccctcttcttactcggttgaaaacgcgtcagagaaggtgcgacgcaacatggacaaggcccagcgattctttggacaggctcctccggctgcaattccacgagaacctgcaatgcgggaaccggtccgcgagccggaagaaacgccctggttcctgaaaacagatcacgaaggtgaagtgttctacgatactaagaatgatagcctcaacttgaaatgtggaacattggcaggcttagtggaacaattgactcgccatgacaagcttgatgcttccttcaacaacacgttcctcttaacctaccgctcatttacatctgcagaggagctcttcgagatggttaccgaacggttcaatattcagcccccgcccggtctcaacaacgacgagatgcaaatgtggatcgacagaaagcaaaaacccattcgattccgcgtggtcaatatcctgaagagttggttcgagaatttctggatggaacccaatgatgagccacacatggcgctgcttcagcatgttcatgcgtttaccaaggattctatcgctacgacaaagactcctggatcaccgcagctgttagctgtcatagagcaacgcctccgtggacaagataataccgttaagcgtctcgtgcctacgcaggctactgcagcgccaacgccgatcatcccgaagaacatgaagaagctgaagttcttggacatcgatgccacagagttcgcccggcagctcactattatcgagtcgcgtctctactcgaagattcggcctacggagtgcttgaacaagacctggcagaagaaagtcggccctgacgaaccggaacctgcctcgaatgtgaaggcactgattcttcattccaatcagttgacaaactgggtcgcggagatgattctcaatcaatcggatgttaagaagcgtgtagttgttatcaaacacttcgttaacgtcgcagatgtacggactagccctttgcccctcttttacctctcggccaagggtagatgctgacgcttactagaaatgccgcgctctgaacaattactccacgctgacatcgatcatctctgcacttggaacggctcctattcatcgacttggacgcacatgggctcaggtcagcggacgcacgtctaccgttctcgaacagatgcgccgactcatggctagcacgaagaactttggtgaatatcgggagactctgcatctggctaatccaccttgtatccccttctttggtatgcatttattgcaggccccggccttctagttatcatgctatcgtttcgagactaacagactgcttaggtgtctacttgacggatttgactttcattgaagatggtattccatccctgactccgtcggagttgatcaatttcaataagcgcgccaaaaccgccgaggtcatccgcgatattcagcagtaccagaacgtcccgtacctgctccagccggtccctgaattgcaggactatatcctcagcaacctgcagaatgcaggcgatgtgcacgacatgtacgatcggagcttggaagttgaacccagagagcgggaggacgaaaaaattgcgaggtatgccaaaaccagtagagacatgagcgccttgactctcgcgagcatggtagtgtcgacgcgctgatcaggtcgcttgttctgcttttttctatccccttccccctcccttctctgttcctgtcgtccagtggttgatctccctaggcgacacggtcatttgtcaagaaatattgagctctggaagacgtcttgatgcttgagtgaagactaacctactactttcccctacgtagattgttgtcagaatcgggcttcctgtagtgctcgcctcgcctcgattctcgcttctccgccggggctccttatcaccaccccggtcgacctgctattcactcggccagatcccgaacgaccacctatcacaatgcttgaacgacgtccgatggcgcgatcgcaattcactccagccacgccatgcaactttatttctcagggggctggtcccatgagccgccaaattcctcgatccgaacctcccttccgacgggtttctcccttatctctgtctgccgccacctggccaatcaagcacttcacctggacatcatgcgacattttcaccctgattcttggcctcgcctggacgatcgtcatctccctgattgaatactgtggcagccgttgcacaagaagctcgagcaatgttaccttgagtccgaaagatgctcctgtcactttcagctctcatgatcatcagtccatggactactggttctgattcttaagaaaatggtgcccaatatggcccattagtccaaagaaatagcagcgcaggaactccatcactgctggcttatactgtgggaaaatccactacgactccctctttgacaccggcctatactcctttggtccatctcttccccgtcgttccttatttcatcatttccttgatagccggacaccatttccgctttatctcttctcgaccaactccagtctcgtatcgatacgactgcgatttcttttgtcttctagtctaccttgacggtcaccatttcttttcggcttcttttcccgatactttacatattgtgtcgaacatatcacctctgtacaatggctcgggtcctttctcccttctgtacaaattctctttgctttcgtggtctctcacctggtgttgattgtgatcttataaagaggcttgtttacggttcggatgatgatttatcacgacgcaggctactattgacggattggtctttgctttgggcattttcattcatgattacccctcttgtcgtccccttgtgctgatctgttctcctatggacatatacacctgctgcagtgtgttagtacatattaaagcacatattacatgcatcaatggtcatcagtgcacaggaatagcggtaacgagacgtaatacgaccaaatacaatgatagcacaaattgctactgagtagacaacaaaaagaaagaagcagcaaatgtatccattaagtcatctcgtcattcatagtagagttgttctcaaatgaaccttcataagcctttcataagaacagaagttgagcacaagctcatgatttctccgatctattcccctccccaacattttgaaacagcttcatcttcacttccgccgccaacaaacccttcacttcttccgagacaatccgctgcccatccctcgccaccctctccaactgcggatccttaacttgcgccagattccctcgcgaagcactactctccacgcccctcgtggcccgcttaatcttctgactcaaatccaccatctgcttactcccataatccctcgtcgtaaacaacggactctgactcaacgtcgcaacccaatacttattccacagcaacgacagaatctccgtatccaacgcactcttaaacaccgacacctccagcgaataataatgtgacgcatgtgccccaaagtcctccgccttgttcaacggcaccgtctgatagtcatcctccccagcaccactacccccctcccctttcggcggcgtataatccttcggaaacgtcctaaatgccccaatatccaccttccctgctgagatcgtcctctctggatcaaccaccaccgccacaaacggtcccccgagctgctgcatatcctgcgtcgtcacatcaatgcccgataaccagcacccgtacccgggatgactgtggtaccagcccactgcattttccatccgtcctgcatcccggcacgactgtaggtatgagaccatgtattcgttggcttcgtcttgggcgttgactcgcgtttcggttccctctacgggaagtcggaaggcgtcggttaccacgaaggtttcgggcaggacatagccttgcattaggcccattacttcgagggagccgccggaccgcgcgtgcattaccatcttgaggagtgcgacggcggagattcggatcgatttgaagtagtgtgggtctttggaccaagggcgctgagcgctaagagctttgtgtgtctcttcatcgtatttgtagagcgcgtctcggtgggggtctatgagggtgacggcattttcgaattctgtggttatggggttagagtgctgtgagatggagtgggggtggggatggggttggggatggacgtaccccaggactgctgggcagcctgcatggtggatggtagagtagaagatgtaattggaatagcaagggaatgggataagtgattaacacggattggctgaaatcagaagtagattttgattattggaatgaaaaggtcaagcggagcagtagataatgagatctggatagtagatagagagatggagtgaggtgactccgggcggtgagcaacttcccggcagatcgcggcggagatcggcgctgagtcagcggttaccgggccgacggggtcacagctgaaagcggcagcaaacagagcaacaaggcggcgagcagatcgggattgcggctgcagaatccccaaagggatattgttattgtctttccctccatcaccgctgcctgtctccatcccctccatcccagtcacccttgcatatacccgcatctcgctgagctggtcataaatctggcgggtcttcccttgtcctcgcagatgccactcatcttcccgtgaggcgcttcgctgtcaatcgcagtctcgcgttgttcatcctgcctgtttggataactcgcagctcctctttctaatctctccaggcgcatcgccgccccccgagcgtacatgacgctgacccccgccatttaaaggcgagtttgtcttcgatcgcgcactcaaacaacctccttcaggccaatcagctccacaatacaccaataaccccccctggcttgggcgtgggaaacaaacacaacactatggccgtcgatacaagctacttgaccactcaggtcaataacatcgtcactcaattgcatggaatctttgatgacattggcgttccgaaccatgagcgcgagtccagagaagcagaggttggttgtttctgatatgctcagcacccctcgcgactaactgtaaagcagctcttcagcgcgttgtctgaaacgctgaacaaccacctcaaacttgtggataagtatgcgcctcgcctacattccaatgtccttatgacctagggctaatcttttgtagtgagaaaaaagatatggaggatgaggcacagaacctcatcgaagcaatccagcatatggagaagtccttagtcgatgaaaaggcgaacggacagtaccagcttgaccacaacgaactgcgcattagctacccactgaatcgctgcctcgcctttctccgagaggagcacaacgcattgagcaaactacacaaagagcgcttcgagcaagtcaggagtgagttaatcctaagcgccacaaggcgcgcaattgttgactggctatagaacttgtcgaggctcttgagtcgtacgcgtcgcatcttgaacctacctttgtcgccattgagcttcccccgacagctcctggatcaaccatctcacccagcttcgacctctcgccatcctacgtcactgcgctagacagcgaattcacccgcgtttacgaggagtaccatcgtcgtctggagtttgttcagtccacatctgaagagattatcaagctgtgggccgagctcggaacgcctcaggttcagacagacaccaacattgtcaaatactatcgcgaatcgccagagcaattaggtctccatgagtcggatctggccaatctgatggccaagcgcgaaaagctcttgggtgagaagaagggccgcgagcgcaaactgatggaccttaagaacgccgtcgaagcattgtgggaacgattcggagtcgaagactgcgacagaaaagcgttcatgaatgcgaaccgtggctgcggacttcggacgatcaatgagttcgaggacgagttgagtcgcctgaatgagctgaagagacagaacctgcatctattcgtggaagatgctcggtgtcgactccaagagctctgggatagcctctacttctcggaagaagagatgcttgacttcacgcctgccttttcagatgtttgcagcgatgcactgttagaggcgcacgaagctgaaatcgcgcgactagagaccttgaaggaacagcgcgcgccgactctgcaactcatcgagaagcataagagcctcctatcagagcgggaagcactggccgtttcgagtcaggacgcatcccgtcttatggctcgcggaaacaagggcgagagacgcgatcctggaaagcttctaagagaagagaagatgagaaagaggattgccaaggagctgcccaaggtggaagccgacttgcgcaaagagctggagaggtgggaggatgagtatggccggccattcctcgtccatggagaacggtacctcgacgaactcaccccggttgttgcaaagccacctccacggtccaagactcctgggcctaccagcgcaaaacgtcctaccccagcacaaccgcctcgtccggccagtgtcatgagttctcggcctggcagtgccatgcgagggcctttgccgccgcgctcggcttccaagacacccactgcccatccaactacaaagtacaacaccattggacctgctgctggtagggcaggggccaaatcgccgtcgaaaattccagctcgtgttcccctgggcaatatgccgcatggaagcaactccccgcgccggggtggtccaggcacatattcatctagtactgtgaacggtaagatgccggcacctcgtgcaccaccgccgaggatgcgcgcgttgaccggaggtgagtcgagggaggatcgagcggcatacctgtttgagccacctcgatctgccagcgccttgtcgaattcatttgtgcggccagtcagcccagaggacgtgtatgacgatcgtaaccaacgctcctttgtcagctcttccgcgttctctcaacgctccactggattttcccaatcttcccactcttcagcttcgtcactgtccttgagctcctctatgcaaggctaccccaagccaaacccatatttgcagcaaatgcccccaccgccagcgccaagacaagtgtcgaactccacggtgcagaccgcagtatctgggtcagagaactgggagactttcgatgacggttcggaatccgaagcagacgctagcgacgtgtactatgcgaagcttcgtgctgcacatgggaagcgactggccgatcctgaggagaaccagaaccgctcccttggaggcaagaaagccaaaggcatccgaagcgtcagcccagacgagccagctccccagatggggaacatggttcgagtcagcgacgccgagtggacggatgacttagagccatattgaagtctcccacgtatagcctttcgttgactaatgatcctacttatttgagactttcaggggtctctgaaagaacgtgattacgagacgactcgacgttgacgatttcacgaatgaccctgaagcactctttctgtcaccgttcccactcgcaccatttaatcgttgagcttttcacagcatcaacaatgacttgcgcaaatgcgctcagctaaccatcttaatttcttctgttaaaattcggaattataccacgtgcgttatgttctggcttatctggacgcccaaccttggattttactttgcgtccgacttacttctaccactctgccactcactgcgtgataggcagggcccgacaacccgcgacagacttcagcatgtcgttacctgatgtcacaaatggaaaaaggactgcggaaaaaccaggcgtctttttgtaacatgcctttttgctctaagtttgaataatttacctctacccggactgggatagacggggttggtgttccagctgcgactcctccctcaatttctttttatgataattcgctcgattaccgacttcgaatcttctcttctcttggtgtggctctctggtttttcttcttttttgtcttctatggacgtgtgtataagtccctggcatgcttttgactctatttctgttgtgatatcagcgcggtttgttatctcttttagccgctaagttactttatggttcatgtcctagcaatggatagtatttattccttttctaccacttttactcgaagatcaagagttgtaggatagtatgatcgataaaatacaaagctgtaacatgattcaactgtactgatcatattctacacttctatcatacacttgattcttattacttacacacgtcaccatctacccttctcagatacttcagcctctaccacacaataatctgccagacatatacacctaagaagacccagaagaaggagccaacgaccccatccaagaccgatcctcacccaaactctccactccctgcttaacccgtctcgtcggccccggcaccaaatgcgccgtcaactccttcgcctcctgtactctcctcaccgtctcctctctacccaaaatagccatggtctctgggataccaggacccggtgcaccagccgacaatgcccagcggaggtagtggtatagttccttcttgaaggctttgtcagctgccttctgcgctttggtggattcttcgggcgtgagggtgtcagtgggagaggagtcgtcgggggtggtgccgtcgtaggcggttatgtttgcgcggtgggtttcgagggtccagtgtgccggggggacgagggtgagtgctaggcttgcggtgtggagggatgtcaaagggattgtgttggtcgtagatgagggggtgtaaggggatcggttgagggattgggtgaagaaggtcgagttgcgggttgtgaagtctgcggcgttggtgtaggatttggcgtcggcgcggaggaggggggcgatgtatgtttgtagggaacgggattggaggagggggttgctgtgagtgagtggttagttggtttgtttgagtatgtgtttgtagggtaagggagtgggtgtatgtacagttgcgcggctgggtaggtcttctcgacttcttcggataccttggtcaccatctcggtgaattcgggcccgtcggtggaggcgaagcgttgggcgtgcgctttctggaggaaccaaagcttttcgaaggccacgacggtgttgccgcgggtgattttgaggttgaactgtgttgcttgtgttagtgggtttgagtgagcgagtgaaggaggtagagggacgtacgagttgctccagctcttcaaggttgaagatatccgacttctgggtgtgcgaccagcccaggagagcggcaaagttcacgagggttgcagcaaaaacgccttgggtgtccttgaagaagctgaggtcgatatccgcattgcgtttgctgagcttctgtcccgacttgtccacgaggagaggtacgtggccgaactgcggaggcgtccacttgaaggcgttgtaaagcgcgacgtgcatgggggtcgagggcatccattcctgggtagagcgtaagcttgtgcaacttcttctatatatcttccgcagcttaccgttcctcgaatgacatgggtgatcttcatgagatgatcatccaccacgttcgccagatgataggtcgggtgtccgtcggacttgatcagaatgggatcgtcatagacacgctcgatcaaatccaacttgttcggcgagcggttctggcccgtcttgccgtacaccagatcgttgaacatagggtatccttccaccttcagtcgaacgacatgcgcttcacccttggccgccctctcttccgactcctccgcagagacctccccgcatttcctatcgtaaccggccggcagtccagcttggctgcgatgtctggcgaaagcgtccaatcgatcggcggagcagaagcagcggtaggcgtggccgttctcgatcagctcctgcgcgtgggagcggtagatggcggttcgttcggactaaagcttctctcagtaaatggctccgatgcacagggaacactgtctcctcaatcatacctgtctgtaaggaccgtacggaccaccgacaaccggacctgtaagaacaaccatccgtcagtcatctaaccagctcagctcctttccgcacatattgtcttccgcaccttcatcccagtgcaatccagcccaccgaagatcatcataaagcctctgctcagcatccggaattgtacgtttctgtagcagattccccaattagctcctacctcctcccaaaaacctattcaaagctgtttaaccagctaatcaccgcacctgatccgtatcctcaatgcgcagcaagaactgtcctcccgtgcgcttcgccaaaaggtaattgaacaaagccgtccgcagagatcccaaatgaaggtagccggtcggagacggtgcgaatcgagtcctcgccggcgagtcaggcaatttagtttttttgttgatggtattgttgttattgccagcgcggagattcgagcccggcgcgacggaggaataccgggcttgacattgggtgcagacccagggacgacgggcccagatggtgggggctgttgggcgcctgagcatcgcgagtgacaaggtagatatcgaaaacgccgatgctaatgctatataagtaacaagtatgcgctgaagctggggaaaatcaatggcggagaaagaaagataaatcccgacagaaaaggcggaaagcgcaattatatgtgatgtgattggtgggtttggggcggcaataaattattatcgggcgctgcttttatcgcgattgctttagcctttttacttttacggcctcagccgctctctctccctcttttctcttccctcctctaattactttgtcgccaggaacacacggctttgctggcttgagactttactcattcatccttttgcttgttgttgatactgttatctttgataccctttattcgtcgcttgtgttcgtcgaaaatcttaccctctacttcctactatcagtatgtgttcccgctatcgcttaaaatttagatgttactagcttgagcctccggtatgctgactgatttggtatgatttagtgtcgaaagcggacgttgacctctacggtatatatattgtctactcttaatttctgcagagagaaaatgcggaaagccaacattacaacagcgactaatcagaatatgatggattacagaggtcttgggcattgacaagagtgccggcaaagatgatatccggaaggcatatcgcaaggtattcagattctctatatcgaacacagtattgaagtacagtctaatactttttgggtccaaaggccgctctagcaaatcaccccgacaaagtccccgaagccgaaagacaagatgcagaggtccgattcaaggccgtgcaggaagcctacgacatcctctacgacgaagagaagcgtgagatctacgatacccatggaatgggcgctttcaacggctccggtgaaccgggtatgggcgcgggccctgatttggatgatattcttgcgcagatgttcggtggtatgggaggtatgggcggcatgggcggaatgcccggtggtccgcatgcgcgtaagccgcgcaagagcccggatgaggagcagaagtatgaggttcgcctggaggatctgtacaagggcaagacggtcaagtttgccagcacgaagaatgtgatttgctctctgtgtcagggcaagggtggtaaggagagggcgacggccaggaagtgctccacttgcgatggtgaaggtaggttcatatacctatgggacttggtgtgcagaattccgggctaatgtattgcttcgcaggttacaagcagattttgcgcccgatgggtcagttcctgtctccggctatggttccctgccctacctgtaacggagcgggtgactactttgtcgacaaggataagtgcaagaagtgcaagggcaagaagaccaccgaggctaagaagttgctggagatctacatccctcgcggggcgaggtgagtctagctatgtgtcgtactgcctcgagtgcagtaactaacactgtgattagggaaggagacaagatcatcctcgagggcgaggccgaccaggtgccgggtcaggaacctggagatatcgttttccacatcgtggaagaggagcacgagactttccgaagggctgctgccgatctgacggcaacaatcgatgttacgctggccgaggctctgacgggcttctcccgggtggtagtcaagcaccttgacggtcgcggaatcgaaattcagcaccccaagaccccaggtgaggttctgtatccgggccaggtcctgaaggtgcctggtgagggtatgcccatcaagcgcagcgatgcccgtggtgacctgtacctggtcgtcaacatcaagttccccgacgggaaatggaagcccagccctgctgttctggagcaactcaaggaactgttgcccaagccggaaccccctattcaggctgacaccgtggacgaggtagagttcgaccccaagggcaatctggatgactttggggcgcatgaccccgaggggggttctgcatgggaggatgatgatgagggtgagacgactgcgcagtgtgcgacccagtagacttttggcatggcttatgctttctctgtatctgttttgcctctgctccttcttttgtttctgtccttttcgaggacattatacctctctgctagttcacctcatgatgatagactcgttggctgcttctggatcagctcctctctcgcatcgtgggcgtttcgggtcaactactattatggattgatcgatgagataaatatagttttatgatgggaatgatgattgttgagtgtgcaattgtctgtttttgactagacaatagaccttgtgcagagagctccctagtccgagccatgtatcaagtagaagcgattgataatctgtgggtacccgtggggaaggcaaaagcgatgtgcgatgatttactaactaccggtagaatgagtagcatagagtctgactagatcatgtcatggcatgtcgagggtcatgttggaaggaacataaaggaaccgtcattacctgtatttagttctgcctcctctgtcttatcaaaagggcatcgataagcctactttttgacgtaattgacttggcagcaggtattattatcttagttttttagtataatcgcaggtgccttggaggatccctgagtatcatcaagtgtgcgaggagatataggtcccgcactggaaacggagaacgactccctctcattctctacacggaagctgtcaacacatattgaaggatataagtgcagaagagaaaaccaggcgtccaacacgggttcttcgaatgcccgcagccccttcaataaactatgactttaagctttgtaaagctgtataagggtttcgttgcctacccaccttaccgtcttgattcagctactgaacaaacccggcacttatgggcgcatcccttcgcttccccgtactcccattgtccggaaggacacctgtagtcctcctttttggcgtgagcgggacactttgccaaattcattgttcagactgtggccgcaagagtagcgaatctggtattgagtgcaaacatcacgtttgcttttagtcgctgaatagcttcatatcattactctgcaaggaagcggtatatagtgcctgcagcacattggtcgagaagtctagcgatcttttcgcgctgtgccaaagtataagaaaggcagtcaactagcaagttccttagcatttgttttcacagtataaaattcctcctctgtttacttatgagctatttggattgcatcagtatagtttacaatacatacgacgcatggggtgtgggaaactgagtttcccgacccaacccaacacgaacctgtgacgccgtgcattgcaactgcacagcaccggattattaacgggattgcaaaccctggtccggaaccgactgtgctggttcaacccactcgggatgacggaatgcatgaagaccgaaagaagaattgtaacccccatgctctttctccaggcccctccgtgcccccatggatatagcgtggggtacacctcccacgggctccatcttcatcgactcgaccaaccaactaaaccaacccgagccgagagccacgcgatccaaggctgatttccgaaacattggtacggggtcctcattacacatccagcgcctgttttgctggctatttaattgtctgctttcccgctgtgcctgagtcttcgatccaaatagtttccgagtcgttatttaacctttcattgctttttcttccgctctcttttgatgcccctttcggtacgcggctaatctgactcggacattctccgccgaattgactcggccccggcgcaccgcattccaaatcccggggtaaccttcttggtgtcaaggcgtcagagcagcggtctttatcttgcgaccctgcttctctccatcatagtgactttgaatagccatatagctagtggcctgttttaggcgcaggcatcacgtcgacaaataagggactatccaacatgtcgtgccagtcgcaggcttcgtgtgagggctgctcttgcagcgacagtggcagcaaaggagtggttaacattgaagattgtgaaaccgagctgcttgccctccggaagaggaccatagaacttgaaaaggctcttgcatcgatgaagagttcgtcaagcagcacgccgaaagccggacgcaagctgcggtccacgaagtggtttcagtgcgaaggcgatccaggaatgatggccttgtacattgaaagataccttaactatggtgtgactcgggaggaactgatgtctggcaagcctattatcgggatagctcagaccggatccgatctggcaccgtgcaaccgtcatcacctggagcttgccaaacgggtccgagagggtatcagaactgctggcggaatcgccttcgagttccccactcaccccattcaagagactagccgacggcccaccgcttgtatcgaccggaacctttcttatcttggtctcgttgaaatccttcatggctacttcttggacggggtggtcctcctcaccgggtgcgacaagacaaccccggcatgcctgatggctgccgccacagtcgtatgttgttctgccaggcttgcatcatattcttccatagctgcccaactgactcggattcccagaacatccctgctatatgtctcaacgtcggtcccatgctcaatggctatgtgaaggacgaattggctggttcggggatggtggtctggaaaggcagggagatgcacgctgcaggagagatcaccacggaggaatttgtagattacatttcccgcgggtatgtcacgaattatcggacacacttccttgttttgactaacgcttcgcattagtgcaccgtcagcaggtcactgcaacactatgggtacggcatcaactatgaatgcgcttgcagaagcccttggcatggccctgcctgggtcagctgccattccggctccgtaccgtgaacgagctcaatgtgcttatgagaccgggttacggatcgtagagatggtgcactctgatcgcaagccaagtgacatcatgaccagggaggcttttgagaatgtcattgctgtcaacacggcgattggtggcagtactaacgctcctattcatatcaacgccattgcgaagcatattggggtggatctttcgctagatgactgggatcgccttgggttccacatcccgctcttgctaaacatgcaaccggcaggggagctcctaggggaagagtattaccgagcaggagggttgccggcgattatggcggagctgctggatgcgggcaagttgaatgcagatgccgtgacgtgcaatggccacactgtagcacaaaacgtccgtgggaaacatacctggaatcggcggatgatcagagcttatgacgatcctctcctcaaggatgctggcttccttcacttgaccggtaccctatttgactctgccatcatgaaaacatgcgtcatctctgagccgttcaggcaaagattcctagagaatcctgcagatccaaatgcgtttgaggggtctgtggtagtttttgacgggccggaggattatcatcatcggttagaggacccctccacccccatcgatgacaagagtatcctggtgatgcgcggggctggtccactgggctatcccggtgcagctgaggtggtcaatatgcaccctccaggaaggctcctgcgagaaggggtcaagtcccttccatgcattggcgacggacggcagtcgggaacttcaggatctccatctatcttgaacgccagtcctgaggcagcagcgggcggcaaccttgccatccttcgggatggagaccggctccgagtggaccttaaccagcggcgggtagacatccttgtccctgcggacgaattaaagaagcgaaagcaggagcttgaagcgagtgggggttacaatatgccggaaagccagaccccatggcaagagctcttccgcaaggaaacgtcacagttgagcgaaggaatggtcctccgagaagcagtcaaataccaacggctggcgcagcgatacccggagcccaggcacaatcactgaataattatagtttttgttatgacataatttgagcattgaatgaacaacacttctttgacccaccagctacttcatgaggtggcgcgtgcgcacaacacagcacagctcatcacgcaggcttattgcttgatgatttcatgctgtgtaaacagctcagtactttcacagtatagaagacgcgattggtaggctttcaacacctgatcagacctcagttcggaggatagaccaccggtccaatagagctgtatgagcttaatagctaatgagttagtgaaagctaaatctgggaagagagtatatgcgagatagcatctccgcgagggtactaggttgaggaacagagactcgggcgcgtgggatggtgagtggagcacggagtatggagagagctctgaaggaatgtgaagctaagctccaggccatctggccactgctcaatcacgggattcccagcccctcctctgaacagttccgtcttcttttcgtgcctgggaaagagcgggagacctgcgatctgtgcgacatccgtccgtgagcttctgttgactcactcccgtctacctccaacccgcctaaacagtgccggtcttgacaccgccataatgtgtttgatagcaaaggggcctgagcaacccttagaggcacttgtggtggcccagtggtgtattgcagaacaaggaaccttggaatgactgcacactcgcatgaacaacacggcaaggccgtgataatcctggcttctgtgatttgatcccaagaatgtagcttgtcttggccaagctggctaatgcggtgattatttctttttcgaacctcaatgttgctcatctgctaaatgctttgataggagaacggcactagtgatatcatgatcgggcgatcgcagccagccagactagctcgctaaggcacaatagccacatggtgtgcaacaccaacaataacaactatgctactaccctcagtactgctgccgaagaaagggatagaaagtcaaatttcaaccgaggaaggatcgagaccagcccgaaaatgagagccaagatcgggtgatttcgtgatagaggtctcgaacccccaaggtgaagtgttcactacgaggtgcttcgggtgacctgatagggggtggtggtcgtgatgaaggccaccaagcaaggacttgagtcaccatggagtagtgtgcgccataggcacagccaccgcagcccggaggtcaagtaattttaggaaatgggctctataggatgatgtgatccgtgatgctcacgttcgtactcggattctcatctttccctctcacacacaccttttctacagctaattggaatgatctagtatatgcatcagagccacacacctcgcagctctgaagcaacatattcaggatcggaatatcaaatacgggcctggatggcggaaaaagacacagaaggggaaaagttaaaatatcgcccgagggtggatcccgtggggctcgggtttcccgcgtcaaagtttcctgttgcagggcaaagattccattgatttagggtgggattagggtgattaaggccacggcaaggatccagttgcaagttcagttgcccacgctaccgtttgggatgacgggcgccttctcagtgtggtctagcccgtgacatcaagaaaaattttccacacttttccacacccacaattcctgagaccgtctgactacctactctgacctcagaccgccccggaggcgcgcaccatctcaattcctgcctctttttaaaccaatccggtgctcgccatttgtcctgttcctctctctctctctttcccagatacgtactctttcgaacaggtatccatgctccttgttcccttctgtccagtcagatgcgagcttgccaccatgcggttctaagaagcaatcttaaagaaagagctgtccacgccgtcccgctgcttctactgctgcgcctgttgctttagctgtctcgcggcccctcttcccagcttcccttgtctcctggtcctgtcgatcagtcccaaatccaataattaaagccagcctcaatccagatttttcttccttcaggcttcgcgaagaaaaagaaaaccaactctccgtccaaaatttaggccgggcctagactgtcgccaggcacgtctacatatacattcgcacacaccgcatcgttacagcgtgtcgtgcatcttgctcttgccttcccctggactcgagccatcttatcggaggcagtctcgacgaatcctactcctttcccaaagcacttgggggcacaatcagccattattgattgttgcctaacatttttctttcctccttcatcttctactctcaggttatactacttgtttgtttaagatgtacgtcgacttataaccagccgttgcaactcgcaaccccttgtttctttcttgatattctgttcatcagcaagcgagcgtttctcgatcttctttcttcacttttgaagttttcaaaaatctctctcgacatcgtgtcatcttgaaaagaaaaaagcctctgcaatattcgttgtcatggctcccaacctctttctctgtttgcggaacgtgttctgcccgacctactggttccagcgtggagaacgcatccaaggttctatccacaaagaggaacattgggatagtcccgttcctggcatctacaagtacatccccggtcgaggatggcatcttgtctacaaagacggcaacgataacgacgaaaaagtgcctgttccgcttgtctattgccggatccttcaccgatacatctttgaacatgaaatggaggagcgctgccgctggcataccgtggaaatccacgaaggcgccaagccagaaaaattcatgttctttctccttgatgatggatacacctgggtggccggatgggatgccaagggcaaattcattcccggtccttaccagaaatggcactacgatgcagagtcgaggaccctgcgccgggtgctgttccccgaaagctcgaatgtgtcccgggctagcattttgccgaacaagatgaactgatccttacatggtccttcgtcttcgagtgggaacaaatcgaaaacttcttttgctgtcaacacacttggtttgaccatcgcgatgctatctgcagctggattctacagaacatgcgatggtcgattgcgcgtgcacacgactgattgattgctatatgggatagcgtttaagcgcggtgtctgtcttacatgcctttcttccgttcttgttgccttgttttctttcttttcttattttttatgatgatattcacacatgagcctgtaatgctgggatgaatctgctttttctgcagtgaccttgtttacaaagcgacaatggcgttcgggtcaaggtcatagaaaatcggatagactttgcgatagagcacatggggtttggcctgcggtcttcttgttcatttcacatcttttctatttgttatatttcgggtgactgatcattcagcgaaccgcacaatggagcaaaggacagtctatttttacaactacttaatatcttagcatgaacgtatttgtcatggttcacttgaagctcaaaattgagagatgtactcgggtagacattgtgggaaagtttagcgcatgcaagtccgggtatggatgggatcgacatgacagctgcatgagacgtatcatcgcaggattcttcttcctttgctgcagttgatttacatgtgagtcggaacgaaatcgggattgccgtatgcctatggagtacggagtaaaccggaatcatttacctgctccctcccagtagtccaatctatctctacaccagctcatctgatacaggagacaccacatccccatccacaacatgaattagccaatgaatgtcaccaggacactttaagataacagtactctgtatacccatccctttctatcaattatatacaactccccaacccctctcccaatccatcccattcaccaggaacaggcctcaccatacctactaaattactcacaacttcgccccgggagtctcaccatcacgaacaagcaacctctccaacgcccttctaaccccatcctccatcccttccttcgtcggcctcatcgtctccctcgctacaaaaacatgcgtataccccacaacaaccttcacctcttcctccccttccttaaatactccaacttcatacgtcacgctgctattccctagcttcgtgactcgcagccctaggtccaaaatatccgggaatgagaccgatgagaagtagtcgcagtaggaggagaccattatgcccacttgagaggatttaaaggaggagggtgtgggtgtcgtaagggtggggttgttgtgcgtgaagggatccattccgcagtgggtgatcaggtacgtgtttattatgctgtcgaagagcatcgcgtagacggtgttgttgaggtgggcgtacatgtcattgtcgaacctgttttttggggggtttgttagaggggggttattgggggaagggaaggaggggaggctcaccatcttgttcggtgggtttggtggtagatgtagtcgcttcggaggcggcgctttttgagcgctattgaggtggacattatgggttgggttggcgtgtgtataggtggattgtaggattggttggagttatggtaggtgttgaagttaggttggtgaagttcaatgtgtatagatggtagatgaggggatggactgatggatgggaaggttggagctaccgagttgagccgaggcatagttaacgccctgagcaactggggcgtgttgcacggggtgagagggtcacccgagagccgttcgtcgggcggtcgcgcctagtgggattctacgtacttagcgtttagtggttggtgaactaagtctagcttcagaaatcttcaagcattgttcgttactttgattatactttttcattgtttgatttattgtacataacttgacctaatgatgatacagtgtattaagggcttgctaatcaaggttctgtcaattagttcacgggcgctctgtctctcttctgggtctcattgaagcatcttcctcacaaattgtatgaacatctgcttgttatcgccctctcggtattcttccaagtcatccaataagatggatgggatttcgtcagaagctttctattgacctattattgattgtctgatggatgaagtccatccgtacctacctgatgtgtcccagtattccaggctgcgaggtgatacacgaagaaattccattggtagaggcccgagcatcgctactaccatctcagtcagaagctgtgcatctgaatggccaccgtctagtcccctgccgtcaaataggtgatgatcttcgaagagatcccagatcttgagctcctggttagccgatgccgtgacgaaaagcatgggtagactgctatattcatgctcaccaacactccgaagtttcatatttcagccttcactgtccatctaatcccaagaataacttcaggcgcgcgatgaatatcccgttggatcaatccttcatgcatttctcccacccgagcttctccgaaatctgtgatcagtggcatcccgaaaccactccatcccttctgcgatgggacgggcgagactgatagacggtatattcattatcatctacgcaaggactcagatgcgcagtctcgctgtcgtcccactcccggaagattgattcgtcttctgcgggtttgatgatatccttcgcttggatatctggtgagcatattagccgtttgtaggggatagtctgcaacgagtctaagccagtattcattacatgcgcctctaagtgtagataacctaggatcaacaatagctgctacaatgccccctttggtaggtcctcacgaaggctcgttggatctaatgttgctttggaaatgcaggaggcttgtcaataaaggttcatacacaatgcactgatgactgcctttagggcccttaaactcttacttctctaccagttgactgacgagactgatggaataattcgatcggcgaaagatgctccagcacgtgcacttcttggttctaccttgagctgctaatgtatatcttcaatgctacaagctggtattgtctatgcaaggaattggttatatttacgagagaagagaagagtacactgataaacactgcaggtcacgacagaaccacaagatggccggcgcgtttctcgaaaggtgttgcttgcaattatattgcctctttcggaagtgatcgtcatagcaagtgattgacaccttgtggtttaggtgtcaagacttttataactaatctactttcaggttaggagcatgcttttttatactgggtattaatgaggattattctttttcttagaattgtctgatattcttttagcttggtcgggtcacatacatggactacgttctatataaagtctacatataaagctgacaatgtgaattgagtatgtcctgctcgatttgctgtttgactcttaagtgcgcgcagtctacagggtacatcaattcagatgctgaaatgtgcagcatatctgctcaaaggcttcaaatcagaggcagtcaattactgtggcaatagctaagtgtcaattcctacctgactgctcatcaccttgagctaaagaccatgcgatcgtgatagtagaagtctagcggttccacccaaacgccttgcgaactatgatctgcaggccaccttttcatgaaaactgcaaagtcctgtgtcatatgggctattgcttctatcctgtatcccatatcgcacttggacagtcgacgaaccggccttgacaagatcgaccttagaacaatggcttaaattcgggaagataatggcataaaacacaatgggtatcgcatgacatggcatcccccatccagttatactaccacaggatgacgaatacattctttggtgcacttctccagaccctaaggaagtagaatggttgacttgagctatagtagaagtatacaatattcgtgacacctccaacgtggctacgtgatcctcagacgagcttatatagtagattatcctcttctgataaaattatattgacgctactcattcgaagcttgcccttgaatgctgtggactaacaacagtttcaatgaatgcgatagcatggttcagttgagttcaggttggtgtgagtctatacgcctagtagtaagtccgccagagggtcaccagcattatatgtttaactgctttccagatctgcactgcatggttatgatggtcttcaaaatgtaatcgtattagtctatgttgaaggtccagcaaaaatactcctaacaatatgccagtatatagtaaacaaattgaaatacgtttgcttggttaaaggttctatgttgaagttgggattccagccatgcttatgcgggatggagagtatagacggggaatttccccgcatcgccaaatttttcttttctttcgccgccgcggaaccaactcaggaacggatccccttttctcgtccctgtccttccaactcactttcgctttcatttctgccattcttctcacattcgctctccctcctggctccctctcctcgcattaccgcgtacctactgcgacgcggtcggattcccccacccatcatgtctctcgtgcccgtcgacaccactctgcaagtcccacctcctgatccggttcagaagccccctgaggtggccatcacgccctgtgacccatggcctgcaccatactattttgaaggcggcttgcgccgggtgaagccctaccactacacctacaacactttttgcaaggagcgctggcggggtcgtgaattggtggacattttcctgtcggagtttcgcgaccgtcccgcagagtactacgtacgttctcatctcttggctattctttaaagaatcatatactgacatagttgttctggaccgcagaggaaagccctacaagatggccttgttgccgtcaacggcacgcctgctggccccaataccgtcgtcaagaacggccagatcatctcgcatactctgcaccgtcacgaaccccccgtcaccgggaaagagattggtatcatccacgaggatgacgatctgattgtcattgacaagcccgccggtgtgcccgtccactccgctggtcgctaccactacaactccgtgctcgagatcatgcgctctcaacgccatccggaatgggtcccacgaccttgcaatcgtttggaccgactcacctccggagtcatgttcctcggaaagaccgcgaaagctgcagagaacatgaccggaaagctcaaggcccgcaccctccagaaggagtatgtggcgcgcgtcaagggaaaattccctgacggtgtcatcgtctgcgatcagcccatcatgtccgtgagcccaaaggtaggcttgaaccgcgttcgtgccactggcaaggaggcaaagaccaagttccgtcgcctggcgtatatcccgcctcaagctccggagcctcagagcgcttccgacgcagagggacgggtggcgaccccacccccgatctacaccaacgaagacgaaggatacagtatcgtccactgtctgccattgactggccgcacgcatcagatccgcgtgcatctccagttcctcggacacccgatctcgaacgatcccatctactccaatcgcaaagtcttcggacccgatctcggaaagaacgagaccagcgacgagcgcgacaacgagctcattgataagctatgtaatattggcaagactgaagtccccgacaccgtaagctatcggacacaccttaccacagtgcctctggtaccgccgggcacggataactctgttgtggaggagatcatgtcgcgcgagcacgaggccgccgtggagagataccacaagcgcaaaggcgagatgttgtctggcgagagatgcaagatctgcgacacagagctctactcggaccctagacccgaggatctaggcattttcctccacgccgcggcgtactctgacaaagaggatggctggaaatacactagcaagatgcctacctgggctctgccgcctgatggcgtggagggaccgcgcgagatgcccgactgggtgtttgttcccgaggaagaggagattgttatcggacatgctgtcttgcctggcgcggaggacggctcggagtcgaatatccctgctcttgtgcagggtgtcggcctagtcgacatttcgtctggtaggaaggcagatgccgctgcgcaggcgactgcttgatgggatcatgttctaactagtttggttacatggtgcataatttggcgttgcttgcaattgcaattagagattttagacatgttgagatgacggacgacgaactacattatgtcacatagttggattcgtttacttgataccaccatagacaagtttcatctgccacttcaaactggacataatatgtaacaagcgtcatagacagacacaactccatctactggatgttagatactacgtacgtacaatagcagaactcctagcttgtcgagaagaacgagagaagtttaggccatttacgtagctatagtctacacgataggatacgacaccaaatgggaccaactaccaagctacgagatacaactacacccacacttcgaggtcatcaaagagtcttcataagatttgaatttttattcccagactggcagcaccagccacgaccacaagcgccatgacaaaagacccacatgcatgtaaatcaatcatcataaacgctgcaatccagcacatacgtcgtcaacgtcaaagccaaagcccacattagaagatgcgatgattcaaggctccgcaagtccccaatcacaacaaacaagccactccactaccacagtgaagtagttgctgttgctgcttttttatgtcccccgaaagtggttggttcccatttggttggtataagtggaaagagtttaatgaaaaatgaaaatgaaaatgatgaaatttcttgggctttctttacattcattccatatccatttaagcctcggtggtgacgcggcccttggggttggtgaccttgacgccgagagccttggccttggcgatgatgtcgacgcgcttgcgggaggagacggcgctggcgatcctgttttctttattagcatcgtatattccgtggttatagaggtcatgtcagaaagacaggtgaaacgtactcagcggcgtaggtgcggttgtgcatcaacaggagctcaacgtccttggggttgtggacgaggaaagccttgtggccggagggcatcatgtgcttggtcttcttgttggatccgtagccgatggagggcatggggatgttgccacggaagcgtctacggacgcggttgtcgatacccttgggcttgcgccatgactccggcacgcacttgaagcggtcggactggtggcgccagaaacgcttggtgcctggaaggagtttgatgttagtcgggtcgttcgtcttgatgatgtgtgtatgtggtttagttcaatccggctgtatgtccgtggtccagcaagcacttgtcaattcatgttggtggtaaaatatcttcgtccagatcgaatcgaaatttcggtcgcttatgataatttcttcgccgatcatattcgtcgttcgttgtcgttatttttttttttcgcaccaattgattcgttcgctccgatcgtctgatttctcattccatcgcaccgtgtatattcctcatgcttgctggacgactgacaaccgacggatcgtactctggctgggaactggactgggctgggactagcagggagaaaagaaaggacatacgcttcttgacgatggggacgtgcttctttgcgaggaccatctgttctcaattagcatgcaacaggcaagcagctgacagcaatatcacataccttgtcgtcgtctcgcgggctggcgctgggagttgtcgtacgggtcgaaatcgatctcgaaaattcgcgctcaggtttggccgcccgagagagtcgagctagtggctcgcttagcgagtctaactgctctcggtgcgttagggctcattacgcttgccctgcatttttgccggtactgctgactcagccacgttagtgtggtggataagcttgccttgtgccattccacatcaggaatagcgtgtatatgctgtgatctactgagtactacttcgtactttctatgacttccgcctccgcagtatagcagcagcatcgcccgattgcccttgtgatgcttgtgttcccatcgggtaattgagaaacttaattacaaggtcaatgcctgaagtgattcgtcgtacaggtggctgacgccaatgaatcctcttcgctcaaccctgatggcctttagggaaccgagcccctctttccgcgaggctgcagtgtgtagtacacgatgccggcgcttgccatcaggcgttgtccatataagggctgacttctcttccataatattgatgagaaacgcaagatgctgaacaaataaacagcttcattgagatattgttactcccttcttctgtgaaaccaaaggttgccccctccaatctgcaccatgagcttcggatatggtgtcggggacttcctcgctgtagtgaatctcgctaagaccatcaaggaacgctttgtcaatgcacctgaacaattcaaacaaatttcagaagcgtaggtgccgatattatgcacgtctattccggtactcacatttcaccagctcaaaaaccttgtgcaatgtcctccgtgatatcgaaaatacctaccaacaagcggggcttaataccaagcagaaaaagcatttagacgatgtttatagatcttgctatcacgacttgaatgaactgctccgcagattagacaaataccaggagttgaactttggtactaacagcttaggtggtgcatatcgccatttttggaagagactcaaatgggaccaagctagaatggctgaaatgcatcagagaatacattcggatattcatgtcttcagtctcttgagtactagtctgaccaggtatgctcggaaacaccccaggaaggcgaatgctcatgttttccggaatagtcaggtagcctttgcaacgaaagagctcgttgaccaaatcaacaacaccatggaagataaagcctgtcatgagatccttgaatggcttacaacagtaaattatgcaactcagcaagaagactttctcaaacgtcgccaggacggtaccggtaagtggttactaggcacagacaagtttcagcagtggatcaacaacgaaaacaaaaatatcctgtgcacgggcatacctggagccgggaaaacaatacttactgctattgtcattgaaaatcttgaagagaagtgtcaatatgatcgaagtgttggtctcgcctacatatactgcaactttcggcgccataatgagcagagtgtggacgatgtacttgcgagtctgataaagcaattgtgtcaaagaatgttgtcccttcctgaggatataaagtctctatatgcacaacacaagaaacgacaaactcggccgaaactcgacgaactttctgagagcctatccgttttgcttggtcacttctcgaggatcttcatagtggtagacgcccttgatgaatattcatctagggatgaagcgctacgcaggttgttatcggaattgtttcgtctgcagagcaacagcacagttagcatatttgctacgtcacgacacagcccggccatccaatcggcattcgaaggttgtttacagcaagaaatctctgctgccgctgaagatgtaagggcatatctggaaggtcacatatctcagctgtcaagagtcgtgctacgcaacgatgagctacagaaggaaatagtcaacgcaattacgaaaacggtgaatggaatgtatgttccttcatgtgtctcctcaaaaattagctctcgcactgacattcataggtttcttcttgctcaactccacctcgactcattggaaggaaagctctcggtaacggcgattcggagagcactcaagcaattgccatccggaactgacgcctacaatattgcatatgaggaagccatggaacggataaatgggaagacggctggagagaaggagttggcatttcaaattattgcatggattacctgcgctcgaaaacccctgaaaatcacagagctccaacatggccttgctgttgagatcgaagagaccgaattcgatacagaaaaccttcccgatgtgcaagacatggaagctgcctgtgctggcttggtgactgtggacgaaaagagtcatatcatccgcttggtccaccataccgcacaggagtatttcgagagaacccagacccagtggtttccccgagcgcactatgacatggcaaaagtctgcatggcatatttattgtattgccttcagtcaggagcaggcttacgcacagccggttatccctttgcccgctactctcgtcactattgggcacatcattttgcgcgcgcccttgcaaaaccaggactggcacgcggcctcctgctggacaagaagaaggtcgtgctttgcgcacaagatctcgttactcacttgggaattaggaaagcatttcaactggctgtgcaagtgccagaattggtgacagaagcccatctggcggcattctttgggtcggaaaatgcgctgagggagttgctagaagccgggtatgccttgaattcccttgatgctacaaacagatctccattatcatgggcggcagagaatggccatgaggaagcaaccaggtttttgatcaaacaaggactcgttatagatcacaaagaccggtgggggcttactccacttgcgctagcagcaaacaagggcaatcctgaggttatgagcttactcttgagcaatggagccagtccagacttgaagggaaacgctggccgaacccctttaatgctaggttgtcaaaaaggccatgactatgtcatggatggcgatacgatgctatgggccgcaattgattctcaaaagaaggtagtcgaacttttgctcgaagcaaattgtgaccctaatttaaaagatgaacgtggctggaccgcgctccactacgccgctcgttacagccactccgaagttattaagctattactggccaagggggctgatcgtcttagtacagataatgcaggtcagacagcacttttcaacgcagctagatacgggaatgggtttgttgtcgacctattgctcaaacaagggttcgatccaaaccacatggatgcttccggcatgactccgttgttgctcgctttggagcacaaatgctatagaactgctatggcattaatacacattgggatttgtgcggacgtgagaagtagacgtcggggcataacaccattgatttgcgcgatccaggaagaccataacaggatagccaggtgcctattagactgtggtgctgaccctaacctcactgatcaaaaactcggtcgacctccattggtatgggcagcgaggagaggtaattattcgatggtggaagcattgttgagcaggggggttgacgcagacagccaggaccgcaacggttggacggctctgttggttgctatagcgttggatcgcaaagagactggagacgaagccctagttaagcaaatccttgagtctgggggctacccagaagctcacagtttccacgtcatgagccctgtgacgcggcccacacgccgtggttacgagggcattgtgagactacttttgcagtacaaggcgaacccggacgcggcaaacaggcaaggatggacgccgttgatggccgcagcagcagcaggacgcggaagtacagttcgattactgctcgatacgggaagggtaaaccccaagcgtcgggataagtacggccgcgatgctgccctccacgcgcgaagacatgggcacaaccaaatcgcgctacttctctcgcgtcaaatggatgagaccaacatgaccatcaatgaagttgtctgcaccgcaggccagccggaaaacgctcctcttattgtttgtcgtgcaacaggaacacaagaatcggggaagtcgcctgtcagtttgtagcaatcacctcacgtattcgtgaagattccatatatcactggggccgttacttggataggccaaacggtcaggatatcatattttaaattgaatgagtttaggtttattggacaaacaaaattcaagttttgagtatatctgaagaatttactaccctcctaggccagtccatcactgcaaatccaacagcactttcccaccctcacttacaaacatcccctccatcacctccaaatcagccatagcctcctctggccgcagcctctcctccaattgtcccttcaatatcgactccccaaacgcagccacttcataattcactccacgtccctcatacggaacctcaaacgactccccaccactaaccgtcaccgtatcccgatccaacttgaccacacctcgctcacaactaaactcaaagaccgtttcattcacagcagccccatacgacaatgacaccaccccattcgccccagtcttagtcttgaccaccgcatcgacagtgtccacaggagccaaatgctcccgctgcagtcccatcatggccgacacagccgccatagcgtcctctttaccaagaatgagcctcaatccagcaatggcgtggatccctccatcgaggacaaaaccacccttatatgtgggtttgcgacgccattcggtttctggtcaactattagcttaccatatctccacaaatcaagccaaatatggaaaagaaaagaggaaatacatacgatgatacttcgacccctccccaatcaacgtcctcacactaactctgaaagccttcacagcccccaacttccgaacttcttcagctaccctagagaacttcgccagaaagcgccagttctctgctacaccccagagaggcttcgtcgcgagagactggtactctgagagcagagcacgggcggtgctgagatcaccggcgataggcttctcgcttaggacgtgcttgcccgcttgtagggacgcgcggatatagcttggttgggcggggatggggagacttattcgtttcaattcagtatgagtttgtcatggtgataatacctatctccgtggtatagagcaactcacgcaataataacagcctgcacatcttccctagcgaggagatcctggaattgtctaccggactcggagtcttcggaatataattccacgttcttcacgacatcttctttgctcccggagatgagggtctctgcggatttgagagaccgggagtagatggctttgagggtgaagaggggggaggcggatagaatgggctgttcgtttattccaattactaattggggcataatgatatagggatatgtgaatattaccaaatgttcttcctttgcgaagatgcctattatcagttcattaataaattagataagttcatgcgatgttgagatttatactggggataggataagagagggggagggtaccgctgccgataatggctacgccgatgggggtggacattttgatgtttaacaagaggtttataaaagtagtattaacgacaagggcgaagaataaggatctataggaataattgcagggaagctggggaggtgaaagggtctatcgatgctattaatataatttgctataggaaataaatgtggggacgtgcgaggcaatcagactaatggcgtttagtcccggagtgtggatggcggggttcggtggatattcatttcagtttcctacaatgattattgtgtagatagacaaattccaaggagagattaaaggggaaaaaataaaaataatatgtatactatgctatattaatatcctccatcaatgcaataattccaaacgctgcgccgtaaatgctatcgtcactctcataagtacgcctcatcccgtcaggtcatgcatctcatgccaaccataacatggctttcgccaaaacaaaacaccggggtatatgataaaaagcaagcgataatgaagagcgagcaaaagcaaccgaaatctgatatacccccctacccgaccatcgctcggatccgctccacgcgtgccatcgccttctctaagcgctcgagtcgagctcgcttctcgacatctcgacgttccagtaccgcgacccgctcttcgagacgagctcgtgccttgcgttcctgcgcgaccatctcgttcgcctggctgaatagctgcgccgtcaactcctccagttccgtgctcgcctgagacagctggctctctgcagctttacgtagactctgctcccgattcaacgcattctgtaattccactgtctcctcctgactggtggccggctgcacgggttccggtggtgggggcgaagcgaccgtctgagcctgtgtggtactggtagcgctcggtcgacgggaagggaggaaagaggcaagagtagaaagtcgacccggttgcgatttgggggacgtttgtaggtgagtgggcgattgggaccggtcgatttgcgtcgatgcggtggatgacacggatgtgttgtttcgggaggacgattgcgcacgcagtcgtcggatctcttcttcatatgcggccaatttctcggctgcaggtgatggcttccattagttcactatcaacgtatatgttggggttcagctatcctcacccatttgcatggcctgtagattcagagcattgacctggccttccaggtccttcgctcgacgtcgggcatcggttgtggactgtccagcagcgaggaatccgtcctggccgcaagttggacaggcctttccggagacgagagcggcagcgcccgccatagagggcagcgtgccgatgagagtggtggatgttagagcggtggtagtcgtggtggtcgacatggtttgtgccacatgaggtgaaattgaggatgatgtttgatcgtgtacaaagcacaatcaattgtaagaaggcaacgtcagcggaccggaggtgaaactgagcggcgggaggttggaaatgaaaggatgccggaccagtgtcgcagaaagcggcagagagacaataaataggaggccgaactgcttaaaagaccggtcatgcagtggtgcagtgaggcaagggaaggtggttggaggagaggatgtcggtagccagccttgcccaaacaagtgagagaaaccgtgcagaggaagatggggatgaagccggtgagaggaacgaagtcggcacaggcagtaagacggggaagattaattgattaaactgggattgaatgcattaattgtccctgcggcgggaagcggtgggggagccgccggccttccctccagaagcaccaaaggaatgcatcatctccgttcctctgctgcgctggcagttacccagatgatactatcgttggggagacggtgtaactgccaatggatgcctgccatcagatctccggcattgaactaactagtacccatcaccaacaatgttgcgccttctgcgaaccctggcgacgtcgtggaatcttgttggatccgcggcgaggcaacacgtgtggaccgcgccgttgagacccgctggctagtgagttgctgttggtgactcgtcatttgcctgcctggttgatctgccagttgcacctcatgtcgtgacagttcccaaaagctgacttgcttggtctctcgtacaaaggtcctacagatgggcgctcaatacaccgacggggaggcgtgctgtgaaaggcgtcgaccccattccagcctcccggtcaaccgccctggatgccatcgcgttccttcaatcgccagggtaacaccagccatgagataattgatggaccctgcagccttgatagaagatcgggttcccttgctggctcgggagatcttcaaccttaacctatctatctagaaaggagatgtgcgctgaggaatcaccgatgattgtctcccttgcagacctcccggcttcactataccctcccgaccgaatgatcatacatcaacattttgatttcgtatcaacatctcatctccgtcccttgtgatccatcaatcgttacttatcgtttatactcatcatcatcatcacagccttagcatcgtaactcattccatcaacctacgtcgaatgtcacttcttttccctcactggcagaacccttcgatccgagagcgcgataaccacggaaatgcctccgctaactgcccccaacaccgtcaccattgtcgtccagccggctcgctcaactagcagacccgcgaccaagggtcccagtacctgcccgcccgaccaggcgacattgaaaagcccgtacgcttgcgcagtccctccttgatgtccgaagataccggggaattcccgctcgtaccgctccgtgacgttgttgacctccgtcatcaacgagaccatctgcagggtcgaagcgacacctgcgaggaagaggaacacatagagaagaacttggtcctgggtcgtgttgcgtgcgacaagctgaaaaagcagtaatgttgggaaatcgagcaggaagccaacaaaggctacccgaagtgctccccaacggtctactgcgtcacctacagtcattgatcagcagagatagaaggcataggaaccgcctgatgcataccaatccatggagagaggaaagacggtgcaaagagaggtaggaaacatagcccgatttcgaatgatccccagccgaacgttttcatgacatacagcgggagcacctgacctcgttaacttgatattcgaccacaaaggactaagcgctcttccacgggccacataccgtatcaaaagcggaccagataatggcatccactaccgtcgctagaagaacgaccagtaacttgcctgagaatatcaagcggataatcccaggtacggaggtcgacctcccgctggtcagcggctcgccgctgccctcggttggatattcgttaccgaggccagatgtctgtcctgctctagcattggcggtaatcgcatcgtacccagcgccatgcgtttcggcttcatttagcagagcttgtgtctctccgccactgcccgactgaatccattgcgcagcattcttgggttcgaccatcacgagccgaagacagatatctagcactatcaacccaattgccaatacaaataccgcatgatagcccactcgcgacagcctagataatcagtaaatcgccgatcaagcttccaatgcgacaatatactgaactcacatgatccctccaatgaatggaccaaacaccgtccccacagtcagtgccatcgagacatatcccattgcagctcccacctgatccttgcccaccgtgtcgacaacaagagccaaaccaacagtccagaccacagcagctgacaatccttggagactgcgtgcaatgaccaaggacgatactgtttctgcgaaccagaacacgatagtcgtcccagcgagcgcgagcagtccaataagaaacggaagctggcgtgatgagcttctgtccgcgaaataaccgaatattgctagcaatctggtgttagccgcacccataccacgaaggaaggaaacggcacctacgggatccgaagaatataccaccgccgaacgcggccagcatgattgacatccatttttgcactgtgacgattagcctgttgtcttgtcaaatgtcatacagagacatcctacattcatcttccggtacaatcacgcgtgttttgagcacaataggcaagatagggacgatctacattggtcagatgaagctccgagccgatccaaagttggcgcagttaccatgccataaatgaacacatcctgttgccacaatatcagcacaaagcttcattcatcattgtgaaggtcaaataccgtgaagaccgcaatagccaccactgagatcacaaacgccctggaggagcgaaaagcgagcttccatggcggagaactagtggaaggcggatcgggaagaggttcatctcgatgcatcttgacatcgacaacgatgaagacttgttggaatttgaggatgagaagagagctgtgcggggagggagagggatatgtgcgaaagaaaaaagggagaaaaaaacagccagtcggtcggtcaagagctctagtttagatacagacagtagtatgatatgtggggtagcgtagcggaatagtaatcagatggtagcaatcgtagctagtcgcagtctcgtcgcgtccaaaatgcgatagataaaaataagttagatagatagacagattagcagatagataaagaccaacttacgtagtagtctagctctaaatcacagactacgggaatacttgcctttatttctcttccctctcctcaccccgtttataatctctggcagacagacagacagacagctagacacaccagcggcagatcgtatccgcggggacccgacttcctattcgggatgcgggctgggagaaaagagactacctagtaactcgccaatgaatcagatgatggtctgactgaaatagtaagtttccttactactttcattcccttcagctgctactactaggtactgctattagtcgggtcgccatgcatcccgtcgatcccttcgatcgaattaggtttggttttccctcttccgtcagcttcttcgcgcgtactgctcccatggatggagggggagaactaggggggaaaggaagcgattggttgttaggattggttcattcctctgcttttattcgtttcttttcttttagaatgtgatgatggtgttatcctgataggtgttgttgtgtttgtatttgcttatcttgtctattcagctggggtagttggtttatatatagccgcatactagctttgttcctggtaggggagaactgaactccctgaaatgatgattgatcgtagtagttactaatttagctgagtactgatgatggtaattacgagctatagtatgaagcaatttgctcttgcttacgaatatcatctacaactacagtggctttaaactgctaatcgttatcttattcgtatggggaactgcctcgtgtcaactagtagtagggacatgcatgggctccggttaggttgaacaagaaggaacaagactccacacgccatccccggatccagaagcaagacagagttaaaaaggaaagagagtttggagagtggagtagaaagcaactgtctggcagcaaaaggggggtttggagcaaattaaattcggagtcgaacggagggtgtgggtgatcagcaagttcaaaagcataagataaagtgaaaagaaacgtatactcttcttccttcgcatcagccataagggtcattgctgtataacacttcatccacgtacatgggaataactagctcagagaaacgtgaagaacacacactaggaaatttggggaaaagaacaaacttttcgacatgcttgacggaagaaacaaggactagacctgaatcctagatctagacggaggcggcaacccgtaggaagagaaaggagaaagcgaaagaagttgaggacgactctgaacaacatcaaaacaaacggacatcggcgttaaccaaaattcacctggccatctccacgagtgttgcgcattcggcgacccaacgagagccagaagcaaacgagtttggtcgctttataatatgcacgtcggggaccatggtgccaggttttcggtcaagcgatgacgagcttggggggtatccattgatctatgcaaacgtgcggccgccacggcggttgttgcgctgcttcgagctcacggtgctccagccctcgtcgtcggctccagcctcggcaggcccggccctccagttaccattcgccttgctgggggcagcgttgctcgaggcttcggcattcttggcagcagcagcggcctcctccgtctggtcctgatcggcagtcataccgctctcgtcctcaccggcccgccggaggatctcgaagttcgtgccgccctgggcgtgctcggcgacatcgcggccgttgggatcagccggtgtaccagacttctcagccttgggctgctccttggcaggacgctgcttttcggtcttctcagtcctctcgggcttctcggccttggccttctcatccgcttccttcttttggcggatggcaatctggcgacgttcctcaacctccttctcacgagcggcggtgtcaatcggacgggcaccaccgaatgggctagccttggattcggtgttggcggaggggctggagacggcctcagtcacagtccgtttttggaggttcaagcgaggacgagtagcgggggcggcaggagcggcagcaggagagggagggttgctggcctccttggggggctgatcggggcgcatcttggatctccatgcgttatcgagttcagccgcggtgggggtgcgttcttggaattcgcgtctcggggggcgggagccatcctgggagcgtccctcaccccaggcgggggagcttcttctgaaaccaggaccttcgtcgttgcgggaacggccaccttcccggacaggtgcaggcgggggagagagagggcccttgcgttcccagttgctgaaatcacggaactttccatcactctcaaagttgcggcggccactaccccgttcgctgccggcatcagacacgttgtcgaggttgcgtccgaaagaggaacgatcgggcacacggcgctggggaatatcgggcagaggacctctgcgggtccagtcaaactccttgacatcacgttccttggctataggtaccgtcagctggcgcagatcatcataccggagcaaggacacctacgaggttcggcaatgctggtgcggatggcacgtccctggagggtagcgccggaaagatcaagagccttcttcagaccatcaacagtctcaaattcgacatatccgaagcccttgggggccttggtcaacttgtcctccacgatacggacgttggtgacaccacagtcggcaaagaggtcggagatatcggcggcagtcgcatcaaaggacaggtttccaacatgggcagtgtaggggggctgggtgggaagaggaaggggctctctcacggcgtagccaccacgctcacgctcttatattcgcatcagtatcaaacacatatatcgaagcaaaattgcagcaataacacagggaagattatcgtaccaccaccaaagctgcttccgaaaccagaagaaggcgcagcagagcggccgaagctggacggggcgggagctgatatatgtttagcatcgttcgggtcgaaggaagaagcatcatgtgcaacataccggctagagaggcatcaatattagcagacagcgatagaccgaaggcaaggaataagtcacttaccaggcaaaggcatgtcctccatctcatcagcccaagagccgaagtctgttcctattagccaccgttcatccccgcgacgatgtgggtgcacagggactcactctcatcggccaagaagttgcccagagacatcttctgggctttctgcttagagggcgctgtacgtagaaaaaagccattagtatccaggaacagtcaaaggatgcgaaattggcgtaaattgggacagtgcgccggatgaggaggggttaaacgcacccatgattgcggttgttcaagaagtgggaaacgcgccaaggggattcctgtgcgcgtctcagaataaaggttctcttaaaggatttttagggggggcttccgacggggaagaaatcacgatagtgatagtggacgtccaaaggggcgttgagtgatggggggaatgcaggagagctccgcagtgaaggacagagggggaaagtaagttaatccgtgaggataaattttagtgatgacgctagaaaagtcagcctcaaaaaagtgttggtgcggctttgggtcggccgcctcgacccaacccgagggcttttttccaccttttttccctcgcctttttgcggagaaagtgtgtcttctgtccttccgcccctcttctcctctccacccggtgtcttttttcggtcggattcgatgagataataggtatagtgactgtggtggactgtcgaactggtctctctttctagttccctgttactacaattgttatggtggtgaatagtaacaatgttcatcgactctccgcttgaataggccccattccggattgggccaggcattcttttcttcattgtctgcgcggttggctccattttgggaacgaacacttaaccgacacgcaggcaatggcctgcagaatcgctcccttctctctcgtcctgtttttccagtttgctaaactcttcactaacttcaacatgcacttcattcatgatacatttctttttttctctacttgtgaatgattatttcgcagttcctcatccagactcacaaccttccagcaaaaggcattgctactaatggagctagataccattcacctccgaagcccatgacccccacgctacttcagacgacattcccacgtcaagttggcgactaggaaatcgaaagacaaaattatcagtctgaaggacaatacaaaagttatttcccaacgttctacgatttttattattccgatgccctaggcgttttggtgattgtcgattctgaaaaatactgcaaatttatcgccgaactgaatcttacgagcaatggcaaccagctcctgacatccgctgccggctttaacatgaacggtattctcgattcattcagagatagtttctttagtggtctgctacgcttgttggacacacctcaagcccaacttccactccaaggggcctgtcgttcatccaacccttgaaatttcgtcggccgtggcagttctatacgatgatgtcggcatcggctatataatggacttgggcattttggtcacatggttggaatttaagcacctagtatacatcgagggaccaacgtctgcagtattctagtgaaacatgatggaggaacagcttggcaataattcttacgcattcttgggataagggcatatcttgctcttcaccagcccagttgatgcgcgtctttggcatcttcacgctacgcatggacgcgtagcgtggacgctaatgtaggttttaaaagtagacaagcgtccaagagaatatgcaaattacactgctgagcagtacatacgatctcagagctatccaaagtgggagcactattccgtggctatgcttaagagacttcccatagtgcttcatccatgaagcctcacggagcctgcgtagcccaaccagccaattattcattctgttgtaattcaaatgtcaacgcacagcccccgctattcttcagtggtctgcaagggcctctttacactcttgaaagggtcaacacgccaaatacttgcacaacctgagcgacccgcactccactccccatgcgtcccgcagcggggagtcaagatctgcgggccgccaaataccctgtcagtctatgcatacatggcagaagtagatctcgtgccttatcagttcagaaaaagtgagaggcactagggtactgctgtaaaactagtatgacgagacagtgatcgtatgatatataggaccatagatccaatcgtgaacatcaggggtcatcatagtctgttggatattgcgatccacttcaggtagtcttgaaaacaagttagtttcttgtgggatcaagaatgtttgcaaccatattaaacagtttcaaatcaaatcgaacgagcgtagaccacagggtaaataaagagtggtcacatttgttgattccctttactcggtggacccgcttcgatggcgggaagatcaaggcaccgacccgctgccgccaggcacacaaacacaccaccgttgttgacatcatccagtctcggattttgtcgggttttggaatatgatgttgctcggcctttgggactgcactctgtatatcattgcttttcctcctctctggcatatatcccatcgggtctccagaatccgaagccgataatattgacaggccacgtccaactataacgtgtgcctttgcgaaaactgcttcatccctggttccacagtcttttttttcgccttaaaagcaagatggagcacactactgatttctcggtctatttaggtcgtgaaaccccaatgtactttaagagtctttcttgttagttcttgttcttcttattttgatcctgataaagaggttgtgatttgatcacaagatgaatactctccagcgcacatttcccagggcgatcaaggttgctggagtggctggctttgcaggcctgggcatatattacacgaagctgtattcaacggcatttgcggaatcgaatgagccaaagacggtcttctctgggctaggactcaccactttgcgcttgcagagcatcagaaccgttaatcacaacacgaagcgactggtcttcgaataccctgacgaatccgccagcagcggcctgacattgacttgtaatacttgccccttgaaggacggtctatacctcaagctacgctgctaacatccaacagctgcactactagcaatcacacatcctgaagggagctggcttcccacgattcgaccatatacacctataagtgacttaggtgagctcataccatgtctgatttgacataccctgaatacatagaagatggcccatctagcagagggatggagatatatttgtggtcgaggatgcccctgttccggattatgattgctaagtatcgatcgaatctacagacgaaccaggccatattgaacttatggtcaagaaatacccagacgggaaggccagcggttacttgcactccttgaaaccaggagactcacttaggtttgcgacttcattgaaaggatatcagtggaagccgaatgagttctcccacgcctatctcttggctggcggggctggaattacgccaatttatcagcttataaaaggcaccctgaaaaatcctcatgatagaacgaagctgactcttgtattcggcgtcaactccgaggaagatttactgttgaaggaggaacttgatcgctatgccacagagttccctgaccgcttcaactacatttacactgtcagccgtccaaaaaaggagacatctccttatagaacaggatacattgacgaagaacttttaaagagcgtttttaagggttcgacacagggtacaaaggtattcatttgcggtcctccggcgatggaagatgccctggctggaacaagaagatctcctgaggggatcctgagtcgattgggtttctcgaaggatcaggttcacaaattttagactcgtcctaatgtttgatggggctttcaaaatgacgtgtgcagacatggtattataagtcttagaagaatcctaatacttaatattgtccaaatccaatagatagctagcaacccattgtataaatcaggctcctgcttggcatcgggaaggagagggattagataagcatcccgagcctgctctgatcacgtgcacgcttatggatttgcatgaacagaagatgctgattgaaagtgttagccataatgtgccgctgacctgcagttgcagactagagtgtcagtaaccgcaaagatgagcggacagaacaaagcgttatatccggagcccaatgtactgacttcctctttgaaggtgggagccgtgagtggttagtttccaatcccattccggtgactggtagaccggcttgtattgcctcaactcaggaaccatatgtctgagactcattacagcagccctacttactcagtttcattaacaggttctgctggcctcgtatatgggggaatatcaggagtaattcggtcccctcatccggtcattcattctatctcttgcggaatccactggtttgcatgtggagcctccttttggtgtgagttatcccctcgtctatcccttatagatctggaattgatatcaatcttgctgctacagggttgagaagcaacattctgaagcttcactatgaagacaaggctacccctaagcaacgggcttatgtcagcgccctctctggaggagttgctggaggggccgttacgaggctaatgggtgagtttggcagcacccttcttttccccgtttgagagaaaaagaggtggtggtggttggtttactgatggccggagctaggcgggcgacttgtccctggactagttgttttttcgctactaggctatgtcgggcaaagctcttataatgcgatcgacacctggcaaatggagaacgcgaatacgacgtctaagccgttcctgcagcggatggccgactccaaatggatcccgctcaagtcactctcggatgacgattacaggggtattttgaacgagaaagtgttgagtatcgaggctgaaatcgcactcattgacgacaagatcggggagcttgaaaagttaaagactagtggactcgaatcgggcaattcggatcctgcagctaagtagtcggtttctagacggccactagcaacttggctatgggtgcgagaagagaaaaggtacggccatgctcgaatggttgggggccgatcttacatgtccgatctatctatgttaaggagagaattgagtgatcgcgggtgaacgtagatcgttcacttgccctccaagatagaactcccggcagtattgtgttgcacttgcacccagctttgcaaggatgttgtgctcgcataggaaagagttttgaacgttgcgactttggaacttcgaccacaacacgatggtcggatccgccgtatctttaggttggctacgggggccggtgccgccacttccatgagccctccagaaggagtttacctttgtcgtgtatcatatttctcacattgttcccagacacatgtattttaatttgaaacaagaccctgtatgatcatgaagcagaccctagttacatggaacactacggagtattcgcaatcaacaactgtttctttctgctccacacgccaagaagaattctggatattgttgggaaggtttcgtgaggaatccaccatcaagcgatagatacttggtgaggagaatgttgcgcttaatttcaaggaggaaaatgccaaattgccgtgttcgtagataccaaaagtccaacctaaaacgaccacgctgctaagctttgtgtgaggcagggccccatcgagccagggggaaggaacaaaaaatgctccccgatcgacagcagcagaccttttgaggctcggaaggtgcgtcgaattgcttgcttgcttttacttttttgcagcgggcaaacccacatcttttgccagatcagtaaattgctaagcagcaatgccgagccagccggacggtccggccagagaataaccccccgttggtccattgccagcttgaaaaaaaaaagtgggcggctttccgcttccagtcttgaccgtgacgggttcgacctttccgccgctgacaggttgccgctccagtggtttagcatctatggctcgccctcccgatcgtccttacctttcatcataacgcactgggttcacggtggtggtgaaggaagaagaaaaggacaatactcgaatatccagggggaaaaaaacagggacagaaaagcatgactgacttacggctctttcgttactatcacaacgcttcttcagcccctctgcagctcttcccttaacggagacctgttctctttcccggatccgccgaagtacaaccccccatcccctctcaggagggttgcgctggatctactcgggggagctcgtgtggttgcataggcataccattgctccctctggtcatttttcactcacctcttccgtctagaatcactccgcggtctccgaaacgactctccatgatctcttgttggacagttgcccattttgtgcaacggatcggtcctactgaccgcgagctacgatgacgctttttagtccgaccacggtcctcgtgggcttcctcctcctttacctctcctccttccttatcttcgctatcgttcgtattgcgaccgggatctcgattcaacgaataggatatttttctctccgccgcattgcctatgttccccgagatggcgtccagatcgaactccgtggcctcggcctatctctacacccgccctcgtttgcgcaaccaacatggctcagcattcgcctgaccgaactaaaattgactttggacccttcagctttggcaaagggaaagaagtccaccacaaaacccgatgcatcggtttcgcaacccccgttggagaaagagtcgtccaccgagccggataatcgggaagacagctcttccatacccaagcggagcaagacatggcggaagctgacacatatgaaggagcaagtgaagcggctgcatcgacaaatacattggttgaagttggtggatgtggtagccgtcaatacgaccatcaatctcgtggaagctggtcagatccaggttggatctttatccttgggcgtcgacacgaggcgcaagatggtggatcgagggaaactcttctttcggcgcaagagtcagggccctgacgaacatcgaccggcagagtgggtgatgaatgtgcagaacgtgctactcgggatagatggagcggagccaaccgaagtgctggacaatgttcgggtcaatatacatgggcttcttcacaaggaccttgagggtctgagagatgcgtccatcgctttcaaaattgggcgcatgcatatcccgtacgatgatgtgatgactctgatgcagcgcgtcaaacagtctcgccagtcgtccgtggagcctaccaatattgagactgatgacgaggtttccttctcagactttgtggaggagttggatcagcccggaagccgagacgacaccattgtacaagcagtcgccgactccaaagagtttgccgggtcaatccttcgcggaatacaaggaatacaggtggccctgagcttctttaggttaactcgagcttttgagccgccttcgtcaaaacagaatcccgtgtatctgaatgtggtatcgcatgagctaggcgtcgatctgcaccgaatggatcagaagagtcctgctcatcgcatgtatttccaacgcgatgatctcgcccatcaagctctcttggcggccatctctttgtcggtcaccttggacgattgctcaggcgagacggagaacatactatatatcccaatggcgaccacaacaatcaagaccacgctcccttcaaagacgatcagctccttcgatgaccacaacccggaggagcgcaataccaacatactatttgctaatctggtggtgacgtccccatcactcgatctagagccaaagcaggtctctcggctcctagggttgactcaggcgaagaaggcgtctcctcgtggaaagaagagagataaccatcgtttgatttctaggcttcttcccaaagccagcatcaaagtatcggttcacgaacctgtggttcgattcgtcctccctatttccaagccttccgacacccctgacgacgattataatctactaatttcctctatttcctctatatctcttgacattgaatcttcacattcgtctgaaggcggggttcactattcgctctcttccatttaccgggtggcatcgcatcagctgtactaccaaactccgtccggcgttaaacataatctcttgacgactgaaagcttggaattcaaggtgttacttagtgcttcgccagaagtacgcgtgattgcatctggaagcctgaatacctgttctgcacacatggttaacgatgaagtgaaccgtggcattcatcaggtgctcgagcagttccgggctcaaacgcggcatagaaggaaggcctctatgtcattcgaagagcggaaacctagtgttctcaggcgaatcccgccatggttgcttcgatgccaatttgaagccactggcctcagcttagaaattgctggtgttgacacgagtgtctctgaggtctcacgcggtgtctcattccagctacaatcgtggaccgcagactacagagcccagaagtcagaaccaacgactgtcagtttcgcgagaagacggaccccaagtcactcttacattggagatgagtcgtccttccggtttccgcccacgtcgcctccgagacagaaacaagtgggcgccacagatggcagacgactagccctccacgtccgcggctttgagggatttgtcattgaatccgaagactacttggaggccgaacccttcttctcactaccgagattcgaggtggccctaagcacgatgagtgatcgtcttggtccgattagtaacgtcaactctgtgttcaagggcgtctacctacaatactccctataccgctattattgtctcggtgtcgcgatgtctgtggtccaggatgccttcatgcgaaagtcaccggatatgcccgaaacgcccatgtcccctgttcagaaggaattcacctaccccccatcaccacgtccgtccgcgaggggcgagctcatgacatttgatgtccgagcaactgtcatacagctcaagactttcatgcctgccgatcctccaatgttggttcaaatttacggcctgaccgctggctcgcatcgcctctcctctccatttgtgaaagcacatctcattcggttacatgcagaagcgccaaagctcaaaggtgtgtgggccagaataataagcatgaacaacgttcgccttgatttgcgcaaaatgaaactcaagcatggtaccaatcttgtcgagcaaaggtccatcgatgtctgggctgatttcattcgtttgggtgtaccacaccacatggtaatgcatcgcatttttgacaacgtgatcaatacctcaaaggcactcaagcagcttcatgaacgcttcaagggccactcgtctgaattcggatcagtcagagaaccggaagagcccaagaagattcctagagtatcgttacgcagcaaggctttactgttcgagttggaagatgatgctttcgagtggaaacttggctgcatttatcgcaccggcctcatagaacagcgccagcgcttggcccgcgaggaggcattcgagctgaaattacaaaagatcaaggaatcggatcagcgccgctcttcatccagactacgggctcgatcaagtcaccggacacttcgtagtgaacgtgttagcggagagacaaggaggagtaagagtgccgactctaaaccgcggaagagcttgcaggatgacaagcgtggccggggaaagaaattccgctatgataccgagggagctgcctgcctgtcttgcgaagccaaggtttcagctgataatgcctggtttcgtctccaagaacacaattcacggtcctggaaggataagatcgattctgccttacgattccagggcacgtcgatcaaggaagtgcgaaaccttttctcaggtgctgatgagccccccgaagatgtccaagaaacggaaactgtcctctccattccgaacagacctgctctattggctgctttgataagtgacatcaaccttgtcatcgacaaacctttcttccccttggaagattatcccaagttccttaacacaatcggcaaaggcatgccgatgtccatgaagtatgcgttacttgttcccatgagtattcagctggacatgggagaggcgcgcgtcaacctgagagactaccccttggatttgctacatatcccagctttgcgtcctggtcaatctccaaggctgccaagctggtctcttcgaaccaactttgtaattgccgaagaatatcgtgactataagtcggccaggcaagtcaaactcgaattggtaccctctacggagctgccagatgggaccacgagccctcctttcgcaattgaagtctggcgatctgtctctcctgtcaaaacttactctgaccctacgatcgagatcaataccagcctaccaacgagcatctcatggggcatgtcttatcagcctgtgatacaggatatgatgaagattatcgaagggtttaccaagacagaaatcgacccctctgatagggttggattctgggacaagatcagacttagcttccactctcggataaatgttgcatggaaagaggatggagatgttcatcttcgtctgaagggctcgcgtgacccatatgtggtgacaggattcggaggcgggttcgtcatgtgctggcgtaaagatgttagatgggaagtccatactagtgatgatcccaaggaattcatgagcgtcaggagtggggagtacgtgctggcgataccagactacagtcacgaggctcggtatatggccgaagccacagcgcaggacttggaaagtacatcaacatcgagtgacctgaaaaacgccgctcatttcaagaaggttgtcatgaagctttctggtgacgtgaaatgggctgccggcctggtatttgagcgtaacgtggacgagggccaacgatcgtttgaatttaaaccgcactacgaagttgtgcttcagaaccccgttcatgtcgaccctgcgcagcgagaggtaggccaaaatcccgtaccaagacgatttcaagcagctaatttggggcagacctatgatgcctaccgcgggttccgcagcaaccatatccacttgtcaatttccgttgttgctcctgaaagcaggaattggtccgttgactctgtccagccgtctgcaagctacaacaccgttcacttgacccctcggttcttcacacacttcttcaactggtggtctctcttctcgggtgttatgtcactccctgtccgacaaggaccactgtggcctggcatcaccaagacaagcaagaaattcaaccgtcacctggccactgtaaagtatcagttgcttttcgctcctttgtttgtggctcacatctacaagcacaaggaccgtgaagactatgctgaggatgtcgtgactgcaacaggcatcaaggtccggttggatagcctgaaacttgatgtacatcaaagacgggaggaagtcaagactctggcaaagggtcgcctcaagcaaacaaaagcaagtgcgatgcggataaaccaagcggaattggatctgcagtctgcagatttcagggctgtgtcagccagtattgagggcaccaatctcgatgacatcgagcaaaacaaagacgacatcatatcgtccttccaacagcccgtggcttccgttgacctgtctcgatttactattcctgatcaaaaccttgattggatagacatggacgattttgtggagctggattggatactgcctcaagaatcaaaccctcgaacgcagattttgcctttggcgttcacgccgcggtttacctatttccgacagacagaccacggcgaaatcgcgcctgatgaaacggggtatagcacctttggtgatgaaccaacccatgaatgcgtcatgtcggagaataatgaacctcgtcgggtacaaatggagctcatccgagaccgacttgctgtcgtcgaggcgcagactcgcgactgtagtcgtaccatcggcgagcaggaactccgtcttgccaaagaggtcgatcctgaccccgcacttaagagtcagcataacgactatcttaggcaggcagaaacactaaatcgaagacggactttccttactgccgggcttcagcggattgagaggcaactggcgcgggaagaaaagctcccaacggagaggaatcccgaagctttcgtccaagacagcgcttcccggatgggaacagactccgactcgacgaatgatggcaaggaggctgatatggatggcttatactccactcctgacgatgatctggcaagtgacttcaacaacagattcatcatccacaacatccagctgaaatggaacaattctctgagaaacatcatcctgcgctatattcatcaagtcagccagcgccggggatttgtgtactacatgtctcgcagagctgtaaagttcattctcgacattgtcgatgaacaaaacaagaacaagcaaaagcattctaaactgttccggactgcctcaagacgcccatcagatgctggcggacttgtcgacagcgaggatgatgacagtatcgaggatcggatcgaacagttgttgagtgatgcaaagcgctatgtgaatgcagaagagcaagagcatcattctgaccaaaggagacatagcgccgccaagtctgatgggttcagcgaaaatatcgcgccggaattcacacctcagaacagctaccatctgcgtctcattgctccacagattcaattgcagagtgagaagaatcagaagtccgtgctggtagtcgccgcgaaaggcatgcaactccaagtcgtgtcaatcatggacaaggagcgggtgtccgacgacgtcagtggtctcgtgcagcgtcgcttttcactttgcatggacggtgcccagttcttcgtggctacgcaaaagagcctgatgaatcatttgcaattctatgctggcaacaaatatggaaatcccccgggatccgcatggccaccctggctaaaccttgaggcactattcgatttcgaactaaacccgttcggcttttcaaggatcatacagaagacttcggctagtctgcggtacgacaagtacaacaacctccgcctgaagtacaatgaggaggtggcgaaggggcaatcagaccaacagtatagtatgcaagatacggaaccgaggatggaccatattagcgtcgactttcctcacttccgtgccatttgcgactccgccgagtactactctatgtacatcatcattcttgatcttcttctctataacgagcctcttgagaaggttcgaaacgagcgtctggagaggatcatgctcacatccgatttcagtgatctgagaggtgcaccggagatggttttcaagcttcagtctcgcatccgacagctggaagagatcaaggaacatttccagatccatgccaagtacttggataagcaaggctgggaagaccggctggtgctggagaaagatctgactcaatgtgaggatgagcttttcttcttgatgaaggctattacctcctctcagaggaagattgacccgaacatgtcgaagacacaaggcgtcctccgctggaacatttctgcaagcgaagtggtgtggcatttgatgaaggaccagacagagccgctggttgagttccaactcaggaatgctgaatatgaccgcacggacaatagcgatggctcgaaccataacctagttgcagttgaacgattgtatggtctgaaccttcttccagatgctatctatcctcagatcatcgtgccttatctcgatcaggcccggggtcttaacggccctgatgattgcatgatcaaggtgaagtggcatatgttggaggcagttgccggtattcctgtcttggacgactttgaggtgtccctcttccctctcaaggttcagttggagcgggaactcggccaaaaggtgttcgaatacatgttccctaatgtcggatctacggcattcgagaacggcggattctcgccgttcatgatcaaaaacatgaagccgctcgatgattcatctgattctgatgaagaagaaagcccgaccgctcatgcacaccaggataacagtgatctttcaacagacgatctgcagctgaagggtccaggagcaattgagctgaggctgcaaccaacgctgtcgctatcggaagaggccagaccgaagtctcatcatcggcagctcagaggcctcgccatgacccctctccacaaggatactaaggacaacaaccacatccgaccctcaacgagtggcggtttgacaaagaaacgatcagtggacagtctgcgcatattgtctaggcagcccacagaaaaatccgtcgctaacacatcgggcggttcaggaaataatgaagagaaaaagaagttcgcactgggaagactaccgaacaagggcaaaaaggagactcctgatgatctgtcccagatgatgtcgcgcgcgtcaaattacatgacgctcgcccatgtcaaggtgcatgatgtagtgctgtgtctgagctacaaaggcaagggagagcacaacatagaggatctccacgactttgttttccggttgcctgtcttagaataccgtaacaaaacatggtcgaatcttgacctggccttgcgattgaagaaggatgttatcaaagctctaatctcgcatgcgcctgccatccttgggaacaagttctcacaccaccggccttcaaagcagcagcagaaacgataccgggagctagccagctcaacccagcttgtacactactccgataccgcggtgaatgtgtctgataatgctcatagcatggccagtgcagactcgaacagcgaatattcagagtcacaacgttctggcaagtctggcacaggcagttctccgcttgtgcgatcaaactctctcggatccagtatgctccacgagccaagcggagtgataccggactctcgttctgcgagcgaggttgacgtggatgcccgctgggaggtatgttgaatgaagcaaatgtgaaaggacgtcgctaatcagcttttagcaatcacgccgaatcgtcaacccacccactcgacccatgacttcaggcaatgctatgcccaggtcacagacaatcaagacctgggatgagccggaagaaacgtgagtaatgtctctgctaatttattgtttccaagctaagaatctattagaactagtcataagacatccatccgcaattttggtcggaaactgataccttctcgaaaatgagcccgcatcgctctatttagctgactgctacgttggctaactttcgcatcatacctgtcccctattataatccgtcattttgttatctgcacattactggcctcgcatttgccgtgtgatacccccaacgcagtgggtcgtatataggcgtcaacgcttttggtttcctgtttccatcgacgaattatcgatgtctccaggtgttccaggggtatagtgtgatttacttcacttcttgtgtaaagttgattatatttggtttttgtgtggaatagattaatcttattttgcgagtggcgctgtctgacacttgctttcccatttggtctgttattgctggtgtatagtgtacgaagaaaagggttacgggagcacagggctctctcactgttattttgacaaagcgcaatcgcgcagtggacataacatattcatgaatcgtataggataggatagggagggacagaaaagaggcgcaacgttgtttttgctagctcctgtgcttacttcggagatgctagtacctctaccaaatcacatacagcttgaatagacgagaacatccactctttgcccatcaatccgagtctggcggggtgagcttcaaacaagcatggcatttccctggccgagcgccaacatggcgactatcccaaattgtccgcggacagttctgatccttttctgtagctggtccacatcgctcaaggccatcactgcccatatgtccacattccatgtaggtgtacactttatgagagcacatcttgtttcagagacgacagtgatagtagggtcaatgtgatgaatgcactcagtacgtacagtagcagacaaggtaatgaacacgtagaaaaaagggcagaatgggtagtagtataaatacgcctaggaggatcgaggtaaatgttccaaaagtttattgtacagggaacatccttttcattttgtttctatcaccgggatgagccatagtatgctattatgatggtagagcgagaaaagtgccttgctagtcactagttagataaaagctttatttgcacgcggggtttcctaaaatatgacaggcgtactaagtagtgataattggtctagcatcaactttcatttttctcgtgtcggtccgagccctgatatcgcagttcatttacttccatcccttatgcttacgaggggggtgcctgttccaaatagtagtacaaagcggaataaatcggttcgggcccagataggatctgtgtaacataaggtataaacccgctggaggacacgagcattgttgttactgcctgggaagatgcccctttttggttgagcccggtcgacaatcgtctcttcaagttagaggttggtctctggtttcctggaataaggtagatatagtctacaatcacatctgctacatttgatgacagttgcaaagcatttcagaagaccttatggacgagagactcccagacaacaaggccataactgtcccagttcctgcggttgatttgacggtcgaaaaccggtttcggacactcaatgtagccgatatcagtcacatcgttgttcagtacgtaaagtttcgtgtcgagtggtgactgacaccaagtgtctcttcatcgattccatgtgttccaagctaataaatcctgtctcaaaggctgtctgataaaagactgaattcaatcatgcagtcctgcgcaggtcccaattatgacttcgacaagccttggccgttctggttcttcattgggaaaaccttatcaaaggcgtttctggggaatgaggatcagcttgagtggtttaatgctgtgagggtcagagatcgggagtttattacttttgccaatgttgggagagagaatagttttgattcccgggagatgaaccatgaccttgatgaaaaggggatcggagtggttgaggtcgattttctaaagccggtgccgggtgagcggctcaaggcgttttggaagcctgccagggggatcattgaccagaaggttcgagagtgtgagtgtatcgtactcaaacttaatctgatacttgttgaccgtctacatgtgtagggaccgaggacgaaaggggtaaagaacagaatcaagagggagatcctgcttccgcggtatgaggtctattcagtgatgcaagatttgattacgtctttcttccatgtctatgtaagtgcaatgcagagtatatcatgtgaaagtctggccatgaccttccaactggtccatcattgcagctgtaatatgcagactattccaagtcttcaagaacgctctcacataaccgtctaatctgtccccatctatccaacaacatctgcagcttctctcgttcccatgcttttgatcctattttcttatcactatccccaatctcttctccaagatcttgaatcatattctcaataatttctatcgtcccaatgcattccttaagatacacctccacccagcctcgtatcacgttcgcggtcttctgctcgtcgacgccccgctctgagcgtccgcatacgtatgcgcgccagtcccgggtgttcatgtattttaagcatgcggcgtagcgcaggggactttcggaagatagggggtgggagagggtgtagtttcttttggtatgctaagttagtattgcgtatccggatacatggttgttttctagggtgttgagaaaaaatgaataagagggtcgttatgctcacccgaagatctcctgtttcgctaattcttgtttctgcgatatgctgagatcctgaaatattatgtcgtcgaggtagatgcagtcggaggggttggtggagagggtgaaaccatcttttgtctgttagttgaatgaattgggaatgggatgttgggattgatagaagggttatagactgacactcaattaaaaggaagtcgtttgagtggttgccatagctcatgtagacttcttcgcctttctctgaatggtgttagtcctctgcactcatagtgtggaagggatagagagtaccgtatcgccgcgttgctcggaaagtatacttctttccgtcaaaattgacttcgcatgcctgtatataatcaatatcacacacccttatacagatggtacataaacaaagggataaacccaccgcatcatcaacatgattaaaatagtccgcaaacgggaccattccaatcgcatcattccaatcctctggctcatctttcccaggcgacacataatagaaactcctcgaattgataatgcaccagtaataggcgaacatcttccactctgtctcaggatagactttgacgacatttgcccaggcatcttttagtcgcttttcttgctggctgagtaggttctggtatcgtgtgtcgtagtccacacctacagggactttggggaaagtgttccattcccccgagatggagggtgggagaagtatctttcctcgattatgatcttgatcttgcttctctggtgaggaagagtcggcgttgcctccgtagcttgaattcgacacccgaagatgtgccggccagagaaccggcatgctgtcttcgaactcgtcatacgagggccagacactccgccatgcctcgaggctcttaagcagagatgggtccccgtgcgtgagaaacgcagccattatcccgtggatggatgttcccaagggaaattgcgaggtaaatgatgatgggatggagtcgatagttagcattagatccacgggaatggtgagcattatctcattgttctgggcaaattagcaatgcaccacaatatcccattcctagtctaaggagtacagtctcagcagcctacttttattgttcgcgtcgccttcatccccaaacgtcgcccggggaatcgtgccggcgtgacaccctttatcttgatccctgacgcctcggcccattgcataaacgcaagatgctcgtcaccaggtgaatcatccatcttctatcttgtattcttcactattggaccgcgccgttggaatctgttgacgcttgactccgataggaattgtggatgattgatggtgtagttctgcaccgattagataagccgatcgataagggaaattttatcccgcatcaacaacatcacatcgggtgggatgcatcccttgcaggatttctacttcttttgctcacttactcacttctagcttatttctacagctgcactgcactgcgctgtgctacattactgcaaagagcagcaacacaccatggccacccccacagacgcccctcccgactcccacatcgaccatgccgcctccctccgctactggaactccgtcgccgccaacacaaagaccatgctgggcatgctaggctcgtacccatggtacacgcgcatcgatctcagaggatctaagaccttcctcggcaaagtccgtcgcatgatccccaattgcccgacggaggggaagctccctctcggcgtggactgcggcgcgggcgtgggtcgcgtcaccgagggtctcctcagccaagtctgcgagcgcgtcgatgccgtcgagcccattgagaagttcaccgaggtgattcggaattcggagctgaaacgcattggtgttgtcggggatatctacacaatgggtctggagaattggtatcctgagaagaacaagtacgatttgatctggacgcagttctgcgtgggacatcttacggatgtgcagttgagggagtactttgttcggtgtcgggaggccttgacggagacgggcataatggtcgtgaaggagaatcagtcgacggatccgaatgggtgggatatgtttgatgaggaggatagtagtgttacgaggacggatgagaagcttcggactctgtttaaggaggccgggttggtgcttgttgcgtcggaattgcaactggggttcccgaagaatttcaagctgttgcctgtgaggttttacgcgttgaggccgtcgacttgagaggacattgggagttgattcagtgatgtgaatacagcggtgctgtccacctggtttgctggaagcgctggtatcgtctgctgctgagacttgagagtgaacgcaaattccgatgacttaggagccgaggctcgtgtccgactatcagtgtggacgctggcattgataatgccactccagttgaagcggacgcgaagtggtgcgcagcggatgattatgctgcaactttgcactgtaatgggacacttgctgagtggaccactacgtggacgatatacctagatcgtgctgtgcatacccttggagagaacatggcaaggaacacctgtcgcgcggctctaatcacctgttgtgagtggatcggaaggcagagtgcttgtttggattggtacgaagtatcaaatctatctatgctagctgcagaaagtgatgccaatgctagatcaacaaccctgggagacatgccgcaatcgacaagaatgagtctgtcaatgctatgcagtctcttaacaggggctaaaagcatatccaataatgtaagaagcagtgggaacaagcagggtatcggtgcatatagtacagtggctcaggccgtcataaacattccatcataacatatttttgggtcttcatcactcagctagcggtctggtagcgtcacggccggtagaattgaaacggctctgcggccatctgggcatagctcaatgatcactcggtgtagacgggggagcctgcttttctcggaaccaaggcacgaaacttggcagatgatcctgcatcgcctcaagcctggtccgaccaccactgggggcatcaggatcatcggtgtatgggatgcctccctggccccggttttctgcccaagcctttttctcgcgccgaaggtcgctttggacccatggtatcgtgaccaacgtccagaggccagcccatgcgaacggtaaggaccatcctagctacacatcacttagtaccaaattgttgacagttgcttggaatcacttacagtgtatgcgactggctccgaaacagtaaatataattgccgtaatggcggcagcgacaacgatagatcctccagcccaaaaacagttcatttggaacagcatacgccggaagtacgggctagataggtatcgggtgcgaagcgcatatcggtagatctgaccaccacctccatcaactgccactacatcctcgatcaaaacatatagggcggtcggcattgtcgagcctttaggcgttgatgagatccggaagggtgctttaacaccacaaacacgaaggatgtcgagtgccagatacatgctgccgaagtagaacattaccgtcggaaggaccatggcgactaatcggactattgaccacgagggttagccaggacacgaagaagatggaaggaataggttttaccatatggttcttgtggaacggttcctctgtgatgatgtcagtatagtccgtagacaaatggatggaaacacctacacaatcagctcaactgccagtatcaaccagacgatggtgaaattgatatgaaagaaatccagctacatccggtcagcacccacttccagcgaattgtagccacggaaagcatacccatcccttcctagcgttcaatggccgtgctcgcgagtctttccggaacaagttgtagagacgatagaagtattcgaataccgatacacctcctaacgaagccgtcacaatactgaagactataggataatcaatgagttggtgatgagaaaatgagatacagaagcaaatcttcacgtacccaagttatgcgaaagatcagtggcgtaccagagcgcccagtagaggacgagcggctgggccaaagtatcaatcacaaagattgtccagaagatggcgatggacttcttcctcgagcgcaaggagtatgggagcggcggaggctcaggacacgcagcgggcctcgattcttcgtccatcgagttggcagtcgtggtgcgggtgggcgaagtttaatctgtcagtctcacgcaatctgcaatgaccgggtctagggtgatagtattcgagagacaagggaagacatgacgggagaaacgggaatggggatgggaggaacaggaaggacaattcccagatgaagtcaatctgaatgacgagagataagccagacaggccggaaacgacggcagggacgcctcgtaaacgagcccaaggctttttgtggaagtattttgccatcggcggattcgggttggttttggccgtgatgcctgacgtaaccgggccgtgatgtcatgctactagtggtcgatcccgcgcgctccagaccggttctgcacagggttttgtgagacatcttcgttgctttgtttcttcattcttgtgatataccaagggggagaggacagacatcctcatattcccagtactcacggaccacgactggaagtctggtcgtcttccataatgatgttgtgccaggggcggtttcgcggatgccagaagaagacaagttgaaaatgggttgctggctttgcagaatataaaagtatcagaagagttactggagcgcattgaataagttaacagccagtgaccatcacttctaccacttagcaggggcaatgataatagtacttgaggtttgaacacagtccctgacttcggtccctaagggacttaattaacaaatgatccactcccggcccagtccccactagccccatttctctcgggtacaaccagtcaaccactgatccattctatgagatattgaagtctcgtgaatttggcggacctgaccggccaatcttagtgacaaaaacaccttgctcgtagaggataaacgcagaaatggaagtcacaagatcaaaaaagatatagctgagtgggttctattcacgatcttagtactaccactactaaccatgaatcttgctatcgtgcggaacatgcaatgactgagcagtactatgacctgcgaaaaactcttactgtgtaacagtccactctagcttcctgcacgccatgctgtagataatggatcctgccgcacaatgaatgatttctgtcacaacatgttactatacttactccgccttctcgctatattttgttttcagctgacctttgcctgaccttctttctttcctcaccagttcgaatttctcgctttaccgccactgaaagatgatcttccggtaacgactatcacgaacttcttgagaaagcattgtgctaatgaaagtagcaagccttcccctccaatcgaggcatctgtctcaaaattgagcccggatacatatcagatgggctctaagtttctttgcaaaaagactacaagcgggattcccaatactgcagttgccagttgggacgagggtgatgggcagttctacatagttgaaactaccagtgccaactcattaggggagccagccgatggcctcatctaccaggctggcttgtcatccgctgtctgggggatcgggacacaggcaatctgtaaggtcaagacatggtctgatggagtgggaagagaaagcgacacacttgctttcatcgcatcccggttcccacatatccccatccctgaggtgatctattcgtggaccgatgagaaactcaataggtccttcctaatcttgcaacggatccaagggcaaactctggcgagtgcctggccgtctctaactgcagagcaaaaagctgaggtcgcttgcaccgttgcaggatactgccgcgatcttaccgaagaaacctcggagaagctacagtctgcaacaggctgtggagttctcgaacctttcctaaccgtgcatccagaagcgtctcacccgtcctggaaaccccggccattgggtcccttctctcgcatcgcagctgagaagtatttcaacagaatatcaaccctgccggcaccccctataggagacaagtttcatttctatcattctgaccttagtccaaccaatattctcctcacagacgatggtgctgtgaaggctatcctagactgggagtcagctgggtactatccaaaattatggattccttaagccataccgcagtggggggttaatctcgatattgcagacgattctcgttacgactggactgatcttcttgagtcaaaactctctggcctaggatttaagctcgaccacaatcatgttaagtggcagaaatcattggaccgtatattttatgatgtacacgaggtttaaaacgcatcttcctgatatttctaccctatccatattctctgcctaaactaagcacaagtgttctcaccacctacttccgggtctagccattcctgcaaacctaaccgacgtataactggcctgacgagaatgaagatgtttcatgggtggaggctggtcctagcagcgaacctgggccgtggtctgtagtacttcttgtgagaactgaatgttacacggtatagattaatgtaaatctcatgtaagggttgatcgcaggctcgatttccaatcatacagcagagtgtagttcacatccaatatggataaagatgaacctagcatagtctggagcgggtagtcggacaactaggtacacaagacactagcccaaggatggtagtagtaaagcctgtctggaaaggtatgcgagcatcctaggagctagactgggattttgaggatcttagttgtagtagatctgaacgtctgcactcatgacagaacaatgagcttgcttaatagtactgtcaggtgatacctgtggtgcagcaatgtgcaatggcagactagtgagatacgtagaatagcgcaccgtaataactacatacagtgggttctatccaagtgaagcttatactaaaactgccagctttggatctctagtctcttgccagcaggtggccgagccgttagctcgaatgcaccactggagaattcactcctaaagtgaagggcacgggcatctgtaggtggttacatagacaccgatattacataacaagtcctgacatataattcacgtgacagccttccgccacccccgcggcgggttcgggcttcaacgtcgcatatcctccgcgacgctggttcgaatcgcgcctctgtctctgcatcttcctccattttctgctccccaacccgttgtctgggagatggattgacctcaattcctgttggtcgaaatttgaatgagacagtctggatggtgacatggcctaagatggccccgagtctacgcgatttgattgattttctccttgcggagattgccctctgcggcgatcaaggtcagttgcttgtcttttccaattttcttccgatcgtgacggtctcgaatgaatccccaccgacatggccaacccctgcatgcgctatccgtctgattggaccatgacggaacatccagctcgggtcttttcaacggtgaaccttgcctttggatacctgcataaactttatctgttataattgcattggttctagtactattaggactagtcaactaaccttcttcaggcgcttctcctgccgatatactaacctttaccgatactttctatgccaaggcggcgcaagatgcagctggccgcaagcacaccgtggaccgtcggttccaggagaaggtctggtcctggttaacgaagaacccagaggtatccgttggcaaagacagagaaggaaaccatctcagcctccaagatgccgagcgtggtcaaaccaatgcagagacagatcaaaccgccaacggagcatcggactcggtccgggtgtttgtgtctaaagagcgaacctggctcgcagtagctggtcacggaccggatgaaaccaaggtgttccccacggagtttgctctactctctatcattgcatcgcgcaagcacaatggcattgcgcagacagaattagtcaaagtcagtggccaggacaaacgttccgtgccgaagcgtacggatgttctgcagcaaaagggttacatcgagaaacgggccatccaagtcaagtccactcgtaccagtctttgtaccttgcgcaagttcttgacaccagagcacgcccctgtagacagggagactggccagaattcaaatgcgaccaagcaagagaacatgatcgatttcaaagagttccttgatcagctcttccagatccttcaggaataccagattatttctcgcaatgatctgaaacagaagcttggatttgaggatcactggcgctggaggatcttatcccgtgcgcttcggaagttcgaacgtatcggcgtcctcaaacgtgttcgagctttgtcccagtatgccgatactttgaagaagttccacccttgcgtcatgctcatacgagaaccaacggagagagatttcgaactgttcaacgaattcagtcgcggcatactttccaatctagaacaggaagataatctcgatattgaggatgatatggagcaagatggcacatcacagagccccttgcagccagacagcaacggcacagtcggtctagtgaagcgcgaagcagtagaagaggctggccggattctcccctcttggtcgccagataggaacatacacaatcagatctttgagactgttgatcaaacaggaaccgacggtattaccaatcaggtaagcacctgacagatgactggtaataaagaccctgagcaaacgttgactgaagctacctagggaatcctgagagcctgttttggcggctactttagaagacctttggagaatgcagtgagtcgtctcgtagaatgctggcagctatcccaacctccgcacctgcgccatctggctatcgtgagagacacggcgctccagcgcactatcactcactatgtgcattatactgcaatgaacttcaagcagctagtcgattcaggggaggcgctgtgggaggcggttgaattttccgcgaaaaaagcgaagtcaagcaacgcgcacattcatcccgttgatgctgttcctcaacttgatgctcatgggctcaccctcgctgtgccgaagaaggaattgttgaaggatggcaatgttacactgctggagtgcatatcggtagtcaagccggcaaactacgtcttttccggcagcgatgccgtagcggcacgcctggaggatggaacatacacgatccatcaacgtattcggggttctggtgactcaactgcgcagccttatgccacgccggttagggtgaagatagaacgccaggatggctctgatacagagatggctgacgtgccctctgtaaaaccggtaaaaagccgtccaaaaaagtcacaactagaccccgaagccttccgaggcatgtctgaaaaggaaaagcttgaggctcttggtttggatgatacttggacggagtacagtgtcctactcatagaacgcgccgggccgggtgtgtacattacttcgcgtggacgtcggcgaccggctggcaagaggcaggggcgcccgaaaattagccggatcgctgtattcaaaacactgaagctggcaactctgccttggttccagaaagagacggccgagccggatgacgagtctatacttgtatccaggaagactcgtttgcaggccagcggacggcctcaggcctctcctgcagtcgatgatgatgatgctctcctaccccaatctactcctccagctctttctgttagaggctccaaaagattgcatgagcgcgagtcagatactgaacatggaatggagggtgaaagtgcgccaaagcaccgccgtgttgagcaagtcaatagcgacacacaaaatgtttcgtcgactgcagaactgctcgagcgtgaacctgaagacacgcagacgtcacccttgatgcgaacaaaaagaaaaagagcagtgtcgcctatgctcccagaggaggttgcctcgcagacaaacggcggcactgtgtcagataatgcttcggcccggagactccctcgaaatagcaatggtcaaaccgccactcgcaatgaggatttaggaaccccttccaaacggactcgctctggacgagccttacgggacaagaaaggtacaaccacccatttgactgctgctgaaaccggaaaagccgatgccgttgaaggtgagcctgatgcttccgcggctgaaaggccatctgggagggatgccgttaccaatggatcttcagaaaatgtcacggccagcgaagcgactcaacaaagcttgactgaaccagctgcgccctccacggtcgaagacgcgacagaacagaaaaagaaaggtgccccagaagtacctgagccttctggtagaaagcgaaggatatttgcagagaaaggtggttctgtcgctgttctccggagatcgatcgtcatggatatcctggaacaagccggcggagcgtatcctatgggtacagaaatctggtatccattcatgacagcctggcaaaagaagcgacacaaggaaatacccgatctgcgcacaatcagatcggtcgtcaaaaccatggttgatgccggcaaagtccggcagctgaccttcagtgggcgagacaggaagggcgtcatggtaacaaagaagattatctataaggctgacatgaagcccgacgaccccatgattctggatatgcaaaaagaaatgctggccacagatcgatactacttcccccctaatgttgaaatcgacccagagatctcgaagaatggcaatcggggtacgccacgcagagatgagaagctactctcccagctccccgtggaacggggtattaccgtacagctgcaccaaaagccggcaatggttcgcgccgtggaaaaacggcgacgccacatgctgcgaagcgaactgttgcaacatttgagtatgggagaggagtatgagacagcagatggtgcggagatcgtgcgactgatgactttgagtcgtcgcggtgaccaagacgatccacgcgcattgacatccatctcccgaccgggacgtgcgggcgatgggcctagacgaggacaaagacagcaggtggaggcagggctggcttcactgcgcaagatgaggcgattgtggtctactatagcacctcatgcgatgctgatgaatacgaagtcgacgttccatggcaccactggaacttttggtacggaggctggaatcccggctatacaagctgccagagaccgtgcgaaagcggttgggagaaagaagactcatgacctaccgcattcccttgatgacctgttcagccagacgcggagacgaatcatggacgactccggagaagctgacccgcgatcacgccagttcttccgggataacaatactattctcaagtgggagctcagccacgaggatttgcttcgtcgaaagagtgcagatctgttctatatcaaccagactgttcagaacatggagactcccggcatcgaaggcgatattcggttcgatgtcgacgaggaggccggcgaggtagctacagaagtgacacccatgattactcgacataaggcacgcctcgaacgtcaaacttcacaatcgcggcgaagacggtccgaatctgctatggagcctgggcaccgtcgtcttaccaaattgaatgagagcatttctactgacgggaataagcttgcctcggcccagcccatcccgcgccaaccaacacgccggagccgtcttgtctcacagatgccacgcacactagtccagcagttcatagccgcaatcgttgctgtgcgcagcttagctggaggctccgatgctcgtctggttgattggtcccttctctgttgttgcttcccggacatggacccagcctttgtaatccaccgagctagggggattcttggaaaatatcgcctacagatcgccaagatgcaaggcgatttccaagataggttcatcgaggcgtatgctaatgaccaagtccctcccattgactacgacaacctggaagggtacgactggaagggggttattgagtgggcgaacacgaaactagatgcacccaagtccgagaagctccccgatttgcctgcaacgcgagaacagtttgacagcgtctttgaactaagggaggaggcgctcgtgccaatagatgaactgtaccaaaccaaccagtcaattaccatgggccgcaagcgcgccctgatcgctggtgtcccgttcgctgctcctttgccagagaaatccaatcggcctcaaccgcggagcgcggagctgtcacgcttggaggtggtcaagacctgggtgcgggccaacgtggtgacaccagaggagaagtatcgcccggccgaggcgcgacaggcgctggaagtctttggagagcacgtggtgcagcaggcgttgcagtctctggtaacagaacgagcgctctctatgggcaaccgaggtcgcattactccaggccggaactacgacgtgacagagtacttcctgttggcactgggccggcgacgagtcatcgaaagtaccgagctgcggcgggcgcagcggttcaagaccgagatactggatccgacactgcgtaagcagggatacatggacatcgactacaacgcggaagatggcgacatgcttgtagtgatcaacctgtttgccacgggtcgtgtggtgcttcacccgcgcgatgtgccgcgcgagaagtacggactgacggacgggggctacctgacgcggcagatcgacaaggacaagctgcggttctcgatggaggtgcgtccggccaagtcgtatgtgtacggcaaccccatccaagagaagatgaggagccttgtaccaccgcgtccacagggcatcgatgcggccacgcagctgccggcgaagataccgctgtggtatgacatccacgggtcgtttgtccgggtgctgtgggacatggcgttggcggcggtagtaggatgcgtagcgacgcggccgggtatcaatgcgagcgtgatagcggggatgttgaagccgacgatgggcgagtgggaggtgcagctgctgttggagtggctggaggggttgggtgtggcgacacaacaatcaggatgggtagtacgagaatggtggtggatggtattgggggatatttgatgatgtacattttagcatgattcaaatttaaatgactgctatgctatagcgatgtagtagctcatgacttggtgagtcgagtttattttgagacacagatttcatgtcccttactaccttctactagtatatcagacccaaggcttgtttgtctacagataacacataccagaaaataccctgaattatccctccatatcgctctatcactatccccacacacagtcagcccacagatggatggcatttgaacaggacaaaccccttgaatgctacgctcatctccatcccaagcctaccactaccacacttacacccttcaccaccgcgaacattctaatcgatagatgactgaaattacctcctatcgaccatcacataaccatagataacataacaatctaatttacacaaccaaaaccattaaaccttgacccagggtacttgtatagatatcatccaacgccaaacaccattgcttcatattgatcgcaagtataagcagagaaaaaggatggatcactccaagtccatgtcgcgcgtcagacgtcgcaggatcatggcgaccagggcgatgatgacgccgacgatggctcggtcaagccagggagtgtcttgggatgtagttgctggtgcagacgcagacgcaggtgtagctggcactgagggtcttgttgctggaggggtatgttgctgaagctgttgttgaggctgtggttgtggttgtggttgagatgggaggttcttgctgcacacgaggtgtatccgtagctgcagtcacagctgcatccgcgcctgcagccgcagcctcatccacaccctcctcctcctcctcctcctcctccaccaccttcttctcatcctcctgctcatccaccccaaactcccctccgaaatcctccccccccaacatccaacccacccacctggcccttcgcatccccatccatgaaactcctcagcgcaatcaacgccgtccggatcccccatgcaggctgccacgtctcctcatgatggcccgatatactgaggcagatctcgcggttgacttcgaatcgtcccgaaggcgtcaggaaccggaagctgggtgggcggagcgggtaggtgggcgggagagtgatgcggccgtggtagatgccccctgcgtagggagaggggggcggtgggcccaggagtgtgaagtgccagtcgaagaggttggattcggagacgggcgcggcgtggaagtagggtgatgggttggtttgtaggtcggcggactctttgaggagacggcgggttgaaggggacatgtctttgggggttccacccgagggtgtttggtgatgtggatgtttgtgttattatgtggttggtaagttgtaatgagtgaggtattggtggtgaggtgtttggttgggaggtgatgtgatgatgtgatgatgtgatgtagtagtagtcggagatatagataaggtggagatgcggataggccagttggcctgacgtttacctgccttattaatcaggtgtcgctaccattccattggactccgtagtatatagcattcatgatagttctaccgcatttaaacattattcatcctagtatacactggtatacatcaatcccagctccgccattcatcttctcgttcgtgcatctcctcttcgctcatctctccctcgctgtcttgcccccgcagccgtggtgacatcggcgctagtgtcttcatcgacacccccgtgttcggccgctccggatcgcgcaccacatccagcggctggttcggcgtccagttggctgcagcagcagatgcaccccaggcatggccattgttcatattccgctggtacagatcccgctggtattgctgttgctccgccgcctcccgctcccgtcgctgccgcacgcgatcgcgcgcctccatgaacttcgcactcggctcccagtgccagccatcgcctgttgtcgtacacaccggcaccggccatagcagcgggcggtcaccgaacaagtgtcgtagattgcgccgccatcccaggtcgaatgcgtgcggcattttctcgctgtcttcctcatccaaatagttctgataccggtcgtgctcacgctggcgctccatctcggcatatgatcgcgacaatgcctgctgtgctggtgacatccgcatcccggatggtgtcacactgggtggaggcgttggttcctcaccctcttccgcccgcgtcactcctgggatcgcattcgcatgggcgtcgaggatctgccctccgtagtcctgcagccggtgaccgaatccttctcggtcgcccccttcgctgcctagcacattttcgtagcggtggcgatccagcgctttccgcaacggtgacacataccgcgtcttctccaggcattcgatcgtcgtaattccccgcaaagccaggctgatatgccagacggtgaaacccgacagtaccaggccaataatgccaccgagcaccgccagcaacaccacgttgatcggcaacattttatccacatcgatatatttactatcgtccagcatctccgtccatatccacagtgccgcgacgatgaaatccacccagcagaagatcgacgtatatatcaagaacagcaggaatgctttgtagttgtacagtccgacgcaggtcgccagccacggacagtggtgatccatcttcagcacgcagcgcttgcatgtcgagcagtggtgcgcccgatccggtttcgggcactggcatttcttgcagaatcgggatccaccggtcgaactcacggtgtaggcggtatattgtggtaattcggtcactggaagtgcactatattcatgtcgaccgcggccgctgggagtgaggggggatccgggatcggtgaagacggcgaccgtgtagcatgcgttgaggcagatatagaggatgattccgaggaaggaacttgggatacctagctcacatcacaggtcagtaagcagttggatgaagggacggagggaccacagtcacacaccaacccaagcactttcagacggcttgaagccaacactggcttcgacccagacggcccatgtcgttaggctgtagacaaatgccagagggaagaatgatgctgccgtgcagcagtagcgttcaatgcggagagcccaggcccgcggccgtcttttcggccacgaaggcgaggatggaggtgaggctgccagtgttgccatggtcaaatggagtatggagtatcagcgagatgacatccacgttgcgagcgacgattcaaatcatggcgataatcgaatatacaggggtgtggtgtcagcagcgcagcagtgacaactcgaatgtatagcagttggatgatacagtctactataatcgagtccagaaaggagtaaagtgggaatgagagatgacggggaagagcggaagtggagggagggaatggaactgatggatctggcgatctgaggcaccacattattcttacgttacatgtaccgtatcgcacagccacggtttgccgatcacatgcgcctatatttagattgtggctcggcacctgttggtggtttatgaaacagatgcctagtaactaactagtacttactcttcacaatccctcaatcataatcatttatcattgggatttccgtcccgtactatggtataaacatgagtcgctggtgcaaactacagcaccagatataagtatcccaaacgccgcttgatgtactgcctcgatatatgataaccgcatttgcgacaggatatcccttaagaaaccagaccaaaccatataccattcagtataacacaatgaagaaataaaatagtttggaatatagttgctcaggatgtcttcgttgtcgtcaattggccttcttcacaccatccattgacaggctgcgatacagttagcataagcgtgatccaccagcattgcgttacttaccagacaacttaatcggtagcaccaggaacagttggacttgggatacttatagaaatcgacaatcaggagaataaagccgacgagcacggcgaccaaggcacccgcgcgcaccagccaccatgcccaccataatggcttccggccccggaagaagttcactgggttcaacttgttgttgctggcgcctgctccggtgcgagtccgacgtccttttaggaaatcaaccaggctgggcccagtattcaccttctggttgtcatcgggcgtgggagtgccggccccgccgctcatggcaacgtacgggttccgcgccaggccaatccgctcgcgcagcgcgttaggcgaccgaagaagacacaagcccagagccagtcccatgatgaagcctccaatgtgggcaaaattatccaatcccggcaaaagccccaacacgaaggacactgcaatacctaggatcataatgatcatctccacccaaggagaaggacggtccttccatgtatagaggagatccaagatgaatagagcgagaataccgaacagagcaccggagcagccgcacgacgcttcgccctgcccggcatagttgccgcccaaaacaaagccccagattccactggccacatacaccacgaaatacctccaccagccgatcatccgctccatgtcaactcccatagtcatttgcacgatcaagttgaagccgatatggacaaatccagtgtggatgaacatgggaataatgaagcggaaccattggttgggttccggtttgtcgtcaagcgatccgtgcgggtgaggattcggtacaccgctgaagccgcacgcctcagatagcgtgcactcagccaccgacgcggtagcgttcgggcaagggaagagaactgtttcgttggcgttctggatgccagggacgttcttcatgcatggtgtgtaccgcgaccccatgtagatttgcacgtacggggatggtccgatcattacgttgaatgatggtttcgtctcgataggagagcctgtaaattgagctgcagagttgtcagatggattccaagggaccttttggccgacctgacataccattcttcaccagttccacaatgaacacgatgatctggaccaacgtaaacgtatacgttacccacggaatcttctttttgaaaaaccccttcttcctgttcctattcctccgcgctgtcggagcgaccggcggttcgatatcttcgggcgtgggcgaataatgagtgggttggtgcatccagttcggcggcggagatccatttgcatattgattgctcttcagcgggatattctcagagtagggttcctcattcagtcttccaccggccgcataagcttggtcggaaccgagagattgttgactgtggtgaagttgagggtcggctgccgtgggctcgtaaggatgtgtgtggaagtcaggatggcctggggtcggaatgggatcgaagtgaggattagcttgctcataggtaggcgggttgctgctgtaaccgccatggtagtagctgttggctgccatattgaatggacagccgggccggcgaaaggcgcaggcagggaggccgtgtcaatcaggtcgttgtaatgaccgagggcaagcgattgtccggtaaagcttttcgctggcgagtggtagtagttgcgaagtgtacaggaataatttgtgttttcttctgcaaagcagaggttggtttgttgacaggggtcgtctcgcagagatgacgacggcacgtttggcgggcaacaagcagggctgaaacgatcaatcagagaatgcccctgacccggaaccgactttgaactgcggcaatggcccccaacgatcaacgaaacgaaggaaccccagtgagattcagggaaaagtaacgagagattcttccacctacttcaccacaacggggaataaacaaacactgtgaggagaaggacaaatgaacgaaaagccggtgagataaagatggggaagaaagacgcaggacgcttgaagtttaggcaggcggttttcagtctgggcgggcgactatttttgggcgctgatctccaagaaacttcgtcgtcagccgccagtccggatggaaaacactccccgatgactgagcaacgcggatccattcattgtgagcgtcgatttgggtgttcccgcaggccacgcaacgtcccgcgaccgtgaatggctttgaggctatggcacagcagtggtccgttgcatcatggcggtgttccccccaccacgatttaaaggcagggctgggcatgttgtggctggtcatcgttggcgtactcctctccacttctaccatcgcatgtgcagcagcgtgtgcgctcttgaccgacgacccccttccagccttgtcaacatgttcccggttcatcagtcggatccgatgctcgtgtccacgcatgcttcctgacacaattacctacggagtacactgactaagtagggaatcacatcccttgctgcagaccaatcatacacgggttcatatttgacattaagcattactagacatttaacaataccattcgcctaacccacacgaggttcatctgtacctgtacatcgatttgcgtgtggtatccgacctgggagacatcgtattccgaccctgctgtcttgatcgactgattatacaagccaaggaggtgaaaaaagaatccaaacccgagggtttccaacccagggctgaagggtcggatgctcccgtctctatcggagtggaatgccacattacttgccgtcctacacgcttggtccgcgtgttcgcattaaaaaaaaatcgatgcctttccgttcagttcattaagtctgtgcgcagcgacgcgctaaggttgatcatagtagtcccggaaacgccacggcaacgccatcatacgaatcgaatgtacggagtacaacagggtctatcccaacccccaatcgtcagctgcacaacgcactgtgtaactcaaatcagtgattacttaccatcatgacagaccctgttgcttcatacccaaaaaagaagcagaccaaaccaagagcgagaaaaaaaatatatatggtcataatgttgatcaggcagttacgcttaaccaatagccaggtgattccctcagctggagggggtggatatcgagttaacgtgcgagtcgagtatgcccaaggctgcacccatttcctcgctactatgcccagtcaacagccatacgagacggctgagcttctggtacagcagcgcggggaaataaacaagcagtgcccagaacagcaaggacaggacgaccatcacaaaggtgttggccaccagcttctcccctggtgtcatcacatagagtccgaatgtaacctcgtagcggtaatattccagccgaatacggtcgacagatcgctgcaggatgttgcgacggggttgcttcatggacaaatggctggaaccaggacagtttgtcatggtagaagagtatttgttgatcagctcatccactgcagccggcgcatgcgaggagatgtgtgtggaggtcgagggggtgtagaacgaccgcatttcggtcgccattgtcgaataatactagaagactcgcacactggaagggccgtgacttccctgcgctacacgttgtcgagtgctcagcgctttcctgtccgctgcctcgatcggatatcgtgctgagcaatcgcaggggagtgacgcagattcctttgctccgagttaactggccgataagatcctaattgcactggagcgtctccgcgtctcaatagtcggccgtgaagggggtttgtattatcgaggtgggattcgttagaattgggctatggggggaaaggaccgacgcgagaagatcggaagccgggaaaaacttgagagctaaacagacagttgctgagaaatacagaagcggggtcaatgcaaaagagaatacaagtagcggagattaagaggaagagaaggagagcaagcagaaagcaactaaggcaccaggggaggatgaagtaagagttgagttgggagttgaaggagaaaatcggtaaggcgcggatcgaggaaaagccgccgtgagggatgattggaagaaggccgctctgctcaggcaatagtccaactagtccagctccagggcgtcctggccaagaattatttcgaactaaacagccgcggatgactcaagtgtctgggatggtgcagagtccaagtgatgcagagttgctggatcatcgtcattgaaattaatttgcaatgcgacgctcgcgagggcgactcggtcattggccgcaaccggcgcccggaagtcatttgctgggaggagcttcggctgtatcggcatcgcccgcgtcgatggtggttcttccttggttctgtgtggtttgatttttttttttttttttcttttctacctaacctcttgtttttcccttccattttcttcttcttcagccccgtccgctctcgaaccttcattcctataacactcctggaaagtattctcgtaatcagtaattaatccctatgcctagtagttcgcgggaaatacatcaccccgatggagtccaaccttcttgccccggattttccaaaccaaaaaagctcatgccccttagctattttactagcatatctcgcgtgataagggcggccggcgtccacgagttcatattatgatagtccatgtgtcctagttccttgcataaagttcataacgcccttgatcgcgcacgtcccccttcgttgaggtcagcggctgtgatacccgtcggagtggagactcccgcagccagatggtcgctcattctatagagcaaaaggataactacagcggtgccatgcgagctggacgttgaatggaagtatcgggaactaaataccctgcagcaactctgttagcatattgggtatcacaatccttgtgtgctgtgtaactctggctgctggtcttcgatttcggaaccccaaaccttcccaggctagtccgaaccatcctagtcaattgagctaccttggcgcgatgatctaccgtggttggatttgcaaccatctgagaaacataaagcaaatcgaacctagcagctcctttattaggagatcattgtcaatgtcctgaatagggtcacgaccaaggttctggttgtaaatgtcgagtgtaaggagattctcagaccttgttgcatttttgtgttttcatgttgtggaatatatcttcattcactcacaatatgcggcctttgacttctttcccatcatcggtgagactacttgagtgcggaccacacatgccatgtttggattattatcctgtcaaagaagataatggtaaagttgcctgccagagttatttgcacatgtggtcttctaccatgtcaaactgattggtagctcaatgcgcagtcccccatctgccatgtgacatgtatcaatccagcgagcacatgtcgggatgaaaacgcattctgtatgctcagacctctgggagcgtcgtttagctagaatgccactgagcttttcacacagcagatcatcaacttcctgtgcggccacagttcctctcttacctgtatgcattgaccattgtggctccggttagcattatctggagtgaaggtaaggtgatgaagagagttcagattattgaggagaagcgggtcagtaaatacacctggggctgatgttttcttaagtaatatgtagaaaagactgtcccggaaatagattcctctacaagctaagaatagaatacagattaacgtaggccgtactggtggcttttctagcgtattagaaccattgttacacgcatagggctaactgtataagaaagcaagtaagcaagctccattggaaatcgcattgatagtttgagcttactagaactgtgtgttagatgcgtcagtagcatttgagaaattgcaaaaatgcctcagcattaatttcacaatggacttgatgccgaagtcgatgcctctagtttgcttgtcacagaagccatcaagaatcgactcgctcatacttacggacccggacccgtctccgggcgcactgcgtgacctaatactatctcgatcaagtttcccactcttcacttagtagtcaaacagacaatgtcctgatttacttgccaatcaagtccatcagctgcagaccctcaacaaggcgggccgttttgagaacaatgtggttcgaacgttcacttaaggctgcctaactttaccttgatcttgtagcaaataatgaaacttggaaaaacatccagtcaacatcaatctaacgatgccaatgatttgtcttcgcagacttgtatgctcattgatgacgaggtgaagatgaaacatgacagtgtgtatttgtattgactagcgaacctgctcattagtcagagaaatggatgttccgtttcttcatattatcattccagctacttcgtggtagatatgaagagtagctgttgtttaggaagagtctgttgcgagaaaatgaacagctttatctgctagaaaaatgtgactgttaccctgaaggacagttgagatccatgagaatacaaagtcatgcttattgctgaaagcttgaatcttcccaacagaccgcgcgagcaagaagtctgctcagagccctttctcctgagttgcatcatggtcgaaggctgctagaaccaaggttgttcttcctgtcacacacggactaccccaccatatatcagtaaccagattttaccttcttgcctgtgcatcaaatggccttgaacttgatgatatgcgctatcgcgccatagtttcgcttcacaacgctccaggaagatctaaatgtctcaatgtcgtcttatgatagttccacgtcgttcgaggaattcgagatcgccctctccgggcacttagtccccacttagcactaacaagccagccagctgtcactatcggcgggcgtctgagcgcccggaccgctcggtagaatccagagcccgtacccattcgtctactacccacgaccgtgtatccccagtcagcaggctatctgggagtgctactacgaatagagctaatggaagaatagcaccagtcgaagctacgtggcttctagaaaatcacgtctctacacaggtatatacggtttcttagacctctacttccttgaaagaattcccagatccaatatcaggaactccattctgtatccgttagaagcgtattcctatagttagaacatagtctgcagatacaaaaatctcaggcaaggtcctgagcgagcacacttagaattgttttcagcttctatgcaggcatattcctgatcaactttaggcttggaagcgcggcaaacacggaacgtgcggaatgtcgggcgctgttccttgtagggttgccccgttacaaaggtacctacaaagatgctagagcatgattggttattctcttatattataatccactggattagaatacgctttttactttatatttatctgataatcaatacattgataggtactgcctcccttacgataaccacggaatgcgtcgattaactaacataatcaacggtcgggcgggccacacggtcaggcgggccacctcccggtaggattacccgatataatcaaaataaggcctctaaatcaacacaaatgcttgtaaaaacagctatttaattaattagtagataatttaaaacactatgtacgtcggtggcctatattaaagtaattattatagcatggaggcgcgcgcgagagagtctctatatattaaaattaagatttaatcttaatatttttattattttatactttttctactttctatataactttctggatctcttcaatagtagtattttttatataaattatttactttctcaaatactttcttttttatagttactttttataactggtatataattttatattctccttagctagtataattaaatttattattactaattcatattctttaagaagctgacgtagtataaaatttataaataaaattagatttacttaccatttctgaagtagatattccactaatttttaatattttaaaagatattttatattatataatatttaaagcactgagccacttgactggttatccagaattaataatatttttaaataaatataaaattaagaaaatacttgattagaatctagagaaataaaacctgttattctaaaattactaattatatttaattttgataaaatatactaataagttttagaatagatctctaagaagttaagtttattaatataattatagctatattatatctgcttttgaaccatatctccgtacatacatttaaatatactaaaataatcaatatcaagagattaaaatagatgggacgaataagcagatatataaataaatataatcttatttttaatatagaattagttaaattcagatgttaaataactaccatggctattaaaaattagaagactatatttatttactaatttatttctaatcaagagaataaagtatttttaaaattattaaaatctaattttattaatagtctaactgttattactgattttaaatctttaaataaaagaaatggattgaccttcatattatatctttaaatatattttatttttaaaaatcagagtcgaagatagaatttttctattaaaataaatatatttaattataatgatctatttctaatttcctgattaaattaggaacggctgacctgctttctaggaactagttattattttatatataataattatttttatagtaaaccctgttttattaaaattatatatattatttaataaaatcttgtattcttgaataacttcttatatatatttaaactagtcttttataacttcagaatcctctattttagttctttgataattaaattatttagtaaatcaaatttataaaaatttatagtatttaataaagctataagcccagttaatatctacttatttaataattgaataattttatttaaaaataattaaattaattatatctctgatattaaatagccggaggcttactcctcgcttatttagaaataaaatctatttaacaagtaatttctctttattatttaataatttttgacgtgcgttagttatatctttaatgaaaatacgtccagataatcaagcctggagagtagtttgagcgatattataaacacgtattattttataaatactagtaatttagtctttctaaatagctttaataataagaagaattctatcttcctactccacctgtaattttaataggatagatgcttttggtggcatttatgatggttgaaaagcctcggatagatgattcaagatggtgtttttgaaggagtggcccgcctgaccgtgtggcccgcccgaccgttgattatgttaactattactctttgttgacataagtagcaagcatgtgtggatcggtctcacaacatgactcgtgtggtcgagtacacgtccggtgctacatttgtttagttgattggtgtggtggataatgcgccaatactatatcggtgtagacgaaggaggggcatttcaccacttttggatattaaacaccgatgtgaaggtgtccgcctcggaagtacttacccgaagggtcttactttctatgcgcagcttcattaacaacccaagcagaatatttttttttctttcccttctgactggctggctttgacatccgacacaatgcatacactagtagagagactctgcagctgctgcccataaataatgctgcagccgagatcttgtctaactagcccatatgcgattttccatctgctccgaaggacatcttcacatcctacgaatagtgagtgatctcaatccggctgagaacagattgcctctgtccttgcctccatccagacatattcttttcgcataatggtgtgctgccgggcgagcggtcctcccaggattcttgatgcagccgtgtttgatcctgatcgtcatgtcgcctctcagcttcaaagatagaccttaaccgagaattttacgcggatttgtcttgggtcggaaattatttgcgtgattgcgcgattggtctagaccgtctgcagtatctggaagatcagctggtgacagattgaatgcagagaacggtctcttgccaagagaccatagagcatccaagataggcgagcgacttctttctcgatgaacgggaactaagcgcctcggcacagcaggtttccactatgattagtggaacaagattgaaagacctggaggtctgttcttcgagaccgcaccaggaactaagatgccagtcattgctgcatcggggcaaggaaatgattactcggggcttccgccactgtacatcgattctgagaagaggatgtggctaagctatgagattgctggagtagcgattacaaagccactctacatgtttggcgtggcgaggttgacaaaagcaggaatcttggtaactgtccacctgcgatgcgcacccgtgagagataaaagagaagaaacatgaagtagagcgagacggcagtggatatctgcagataagagaaaggcccgtgttatgcacatgcttgcgattctcgtacgaggcaaccgcttatgcacaggccacataccttgtagagaaattgacaaggtggtattttatattatggagagggaggctaaattggaccggcagcggtgagagcagggcaaaattgaagattgacatgctcagcatctcactgatgacttggagactggtagagagatattacagtgcagaagccattcgagtttgatagtgggagctgaagggggtcaccgggtactcacgtctttccacttccttgtagttcggccgttcaacctcgtcaacagacaggcaagcaacccagcgaatctcttgccagcatatacaaatattcctaggcacgagaaatcctgagcttagacgataaatttaatcggtggccacaggctaagtatataccccgcatggctgacgcataatagcggctgacatataggcgatgtgttcgctgtggctcgattctagactcgggcacaattttcggcgggagggcaaagtgttagacatactggaaaattgttccacctagcaaatcagacgctctttcacttcagctgagtttctcgaataaaccaagtgacgagcccaaattgggagctgatgctcccgggttgcactaacatgttgcctgtggtctccattactgagctctcaacggcaaaaccgccctccatccacatctatggcattcccctagttgagaagaaattgtctgggcttcggcacagacagtagtgtgacaagatggtcaacttggcccgtgtgtggattataccgagagtggaggcagggtttattgctgaccttcgctagtccacggagatgctggcttatgcacgatgcccgacagctgtcgttgagcaacagctccgccgacaatcccagaaatactctgtgtggtactccaatcttctagtccttttagtgtcgggtataccccgtgacaagggtatctggtcctatcaccgtgcctgtcaaacaattttccaggtctgcgccgggcgcccccacctgccattagtctgacagccggtggcgaggaaggattttcaatttccagaccttcttactggtgcaatgggccaagaaggtactaggaaagccgttatgtagcacggtggcgaaccatatgcatgctactgaaataaattttgatatacccgacaaccaggatgccagactgcagtgtctgcatctggacccgctccttcccagaacataaatcggccgtcagagcaatggaggtaggatgcggtggcaggcaggacctgagttgtcaaaatttaagtgcccagaaaccgtttcagggagctctacggctcattgactatatcgttacatctatattctcctgataccttccttgcgtgttacatcatgggtcaaccttggaatacacagttcaaccaagtagcgagcttgtaggtgtttctactttctactctgttggtcagagagacacaagctaatgacgcatcatgttcgctgttcagaagggccgctagacgaccaggggttcagacagcaaatctcaatatcgcaggcatcttcgttgtcaacaatcaacagagccttccagttgaactgtcgaggactgatgagagccatctactcaacacgggctggccccatgtccagtcgctctggcccatacttgaagtgggggaattccaggcatattacgatgccttgtggacgccgggacgcaaaacccgtcagccatcagctcttgttgacagtttacttgccatctgcatgcaggtcaccagtactgctgtatccaatgaagcatctggtggcatcgatgtccggatagccgggcaacagctgtataatcgcacccggcaattgcttctccaagaggaacaggctgccccaacgctagccacggtgcaaaccttcatcttctcgagcatttatctgctgtacacagaccgcattgagcccgcatacaccacgattgacggcgcagtgcgcttggcatatggactagacctccatcacgatcccccagaaggaatggatgcgagacagcgtgaggtccgacgccgggtatggtgggctttgtatacattagagagctgtctcaccactagtttgggactgccatccctcattgtccagggtgaggtatcctgcggctggccgacgatctccccaatgggtagctccagttcgaatcacttccaggtgcactgggccaagctgctcatgtcattccagattgtacgcacagttttcgaccaccaacagacagagcttctccaggaaaaccacgagaccgacattcgcaacctaccaggcctcttggagtctctcgcagtgtttatgatgcgtcctcttaaggctatccgggaaggccttaatgcagttccttctccgttacggatccctcgaaaggacggtactcgggggtactcatttctcttgaaaggagccactgttagcctagaccgtacagcccccttgtggcttcagcggcagcagttcgccctagaaatcagctaccacagtctgagtctggcggccctgcggccttttctctacctgcagggcggcgattccgcctctatgccgcgagcacatgcgcacgctgtcaccggtctgaagcacgccgtcaccttaacggtgatctgccaccagagtctgaccgaaagtgagagtcttgcgaggtgcctcccgatcttccgctgccagtgggacagctgcctatatctcctagccttcattttggccaacccaaagtgcacctttgctgcagaagcgcaaaaggcggtggatactgccttggacacatttactatcctcgtgaatattctaggcttgccgcgccgagtctcagagatcatgaatgatctccgcaggcgcgcagaagagatgatccatgtgcctacaagcatactttctccttcaagtcagccagcctcgtgttttgactccgcagccgcgtcatccccaagatatattgcatctagcggcgtcacatccaatcacgaccatctaggcgcgtttgatagggcccaaatgccaccgacggctgacccatcaattggctctgacatgggcagtgttgaaatttttacagcagcggaatccgagctatcgatggaatcggcacttgacgtgtctagcctggcactggaagcaccgagttggaccgacaacagcatattggatattgacatgagttgggtggcggacactgtactggtcgaaccgtggcaaaatagtatggatcatgtattcagatagaaatgaaatacttcagacagggtgaaaagatgcgtagaaagagtaaccgatttttacacccgatttgcacgcggaaatcccgacggtggtgtgccggactgccggtataaaattttattgactcggagaatccccgcccacagcaactaaaagctgagacccaccggcccgggccggactggtttgattcactacttgatgtacggcggttaatagcggccatcgggcaaaaacgaattttaatgtctaagtacgctcaccgctgccctcaccgtatattatactaattatattagtagatgatgctaatcatttctctacatacagtggtttattatttatattcttaatcatggtatgttctaaacttaatctagagccgtataagactaagattattaatttattctattagaattaatttacaagtaatattgctttctatatcaaagtaacataccgcgtacaagtccgtaagcgtataatcaaagattagttgagtatttgaaaaattagtaaatataattatataactactattaattcttttttatatagctgaattaagatgttgttctttaaaaaatatctctctgatataaagattttatatattatataaaataaaagttatacagtttttatataaatattttaataatttttttatagagcaaggccttatctgataaataaataattttaataagtattaacttcagaataatataattacaaagtatttatttaaaatatataataaagaaactatttaagagttaagactataaataaaagtttttatttatttatatatataataaatatcttattattccaaaatctatataaagagaataattatatataaatatctagttaattaaagactttctatttttagatattaattatatactatctattatataattacatctgaggctatataataatagaagaataatatataataaaattatagcttatatataattctagatccagattatatctggtctataaataattatataaagctggatctgtataatatttaaatatatataattattaatatgtatttttattatattatctgggtctatattaatattgatacttatatattagttagtattatataataatatcttaatattatataagaacagaagattatatataataaaatttattttaattataaattaagtcctctcagtaccctgttaatcattccatcttcgtctctgtatgcagtctatcccatccatctaaccaataatcctcacaaaccaacaatgaatcaagcaatactaacaagagaaaggttaatcccgacggagatcgagttagtcaggccagactacatccttcataccccctcctctatgcaataatgcatcagatatagtcaaacaagcatacaccaagcaatcccaagataagccacgttctcatatcactcgtcgagaagacatttatctcctgaggatcacatataataatgctcggtagtacccatccggctaggaactccgacggatactccgggtacttgaacccacttcttgttttctcccaatgagcggtggtcttggcttcatgtgggcgggtatatatttatttctgagggggtagagtgagttgcgaaggttgtggttttcttggtttcgagggattggtgcatgtatagtgagtgcttgtttattttgggattgggggtttctcagggtagaatcggggcgtggatgggtgggtggttggtaatgtgctatatgagactgaagatgtagtaactacgcttagggtagagatggatgcatggttgtgctgctgctgctgctgcgggtggcgcgggaatcccccgttcgagtactccgtgcctcgcttcagttgtgagggattaatctatgtatgcatcttgcaaagcttggtctggttctaaattgcctggatagggcgttggatattagctgaatcatgccacactgtgctttagttgctggctagataatttttccaatattaacagagagaggtatagtataatatgataaccaataggttgagcatctggaaaaagctgtggctgatagagggcgaggtatacagtcagtcgcaaaatttccaatcagactatccacccacgcaccagtcttatgcacaaagaacgcacccttactcctgccgaagcacaattatagacgtgctggactccccatcataagtgtgtatctcctcgatgcacagtcccacacgattggccagctccatccattgcttccttgttcgctccttaccaccaagcgagatcatcaatgacacatcggccagagttgcctgccaaggggcccccacatccggtagcacaatctcgtccacgaggattcttgaatcggattccatggcagtggcgagatgttgaaggatttggatacattgggaatctgggtagtcgtgcaggattcgtcgcaggtagtagaaccttgctcctgttgaaccgaactgttagattagatcggagttggggcactttgtaaaagaacgagatgtacatacctttaatggtctgcggctggaagatgtcgtgggccataacccgcacaccatccagggaaggaaggtggttgaccgcttcgggcaggtcttgcagcacaaggcgtccctggagatggggatacttgtccctgagttgaatacactggtggccatgacccccgccaacatcgacgaagaaaatgtcctctccaagatgcacttgacttgaagcagcgcgatgagcctcttgttgaaagagatcaaagttcgaaaaccagtccgtagacctaaggccggtcatgacttgttgtagagcatcaaacagcttaggatgcttggctaaccattcaaagcaggttatgtctgtttgaaaggctttttgaaatggagtgttcttattatccgttatatcgtcgtaattgttatctgcgaagaacgccggaactgcttgactggctggcccgcaggtttcaaatctgcctcatgataaagtcaatcaagagccaaatagctcatatatgatgaatacttcttacgcatagagtacgaatgcctccgaacgcttatcggcaagcattttggttgttcgcttggcttggaagtgtccaacagtcgtctcttcgatcataccatttgctgcaaggtaacgaagaatgcgttctgtgttgcaagtagatgtgatattagtgcccttgaacttttgcagcttcagatgagagatgcttacccaggagccgtacgtcaaccctcagatcctttgccagctccgaggatgtccatacggagtcgtgcagtgccaactttcggaaaagaccagtgttcattccgagcatgacaattgcagctcgcaggtgctatgaggtgtgttagatgcaatacagcatatgctttatgaagaagaaaaaagtaccgagttgaatagatccatgatcatatccatcggactcaggaggtccggcagaagcgagcgaagatcattataaatgctggcgcgacctggctcatcagccgtgagggccagagtacgaatctgggcgatgatagtgtccattggtagcgaaatgtattgtgttgtcttttggatagcaggaggactgtagcagcatggctggatcttatagagctccctctcagggtttggctctacccgcggagattccgcgggctactgtcatgatgattggtcgattgagggtagtcttcggatccttcgccacgctcgtgtcgacgctcacgtcttgttatttcgcagcaagccatcataatcacttcactcgaagacacagacgtcgcaagaaaggtgcgatgcctcggtcacaaatacagaagccaacttcccgctccaggcctgtatcatgccacttttgtcggtcgcgaaaattgcggtgcagccgtcagcttccctgctccaattgtatcagccgtggaatcgactgcgggctgtactcgcccctagcatcgattgacaaacctcagaatagcaatagccacgagacgcctgatattctgacacgcctgaaacggctagaggagattgttcttccaacagaccgacagtctagtcgagcgcaagaccccaagccagatcgtcgtaggagtcgaccgcagttagagcgaaaggataagcaggccgcggcggatgcgatctggctcgaagcagaatgcgcaagccaggtgtcttgtgtatgtgtgctttcggatctctgcagaggaccatagcaactaaattataacagagttcaatcccaactgacacgacaacttttcgatcatgttcgatgtggaatataaccagcgttatgactattggaggtagcagttcaggccactcggtcagaaacttctcgatcccacttcaccaagagtccgtgatcctgcttgaaaaatacttgcgtgatattacctacatccatcatgttattctcagaggtccactgcgtacaatggtagacaacatctacggcgacattgagaaacacgcacccgtaagcccgggccaggtggcactgcttttgagcatcctgtcgagtgccatgttcacatggactcgcaaggactcagaaaatgcgccctttgcgacttccgagaaggtgaacgcaacatcttccgtgtgggtgaaaggaactcttgatctgctagatcactgtcgtcgcatatcccttcaatctatcgaggcaattcaggcaatgatcatactttcctttgccatcactaatattgaaggtatcactgctcgattccgtgacctgttgtcaacagccataacagcagcgcgagaactctcattgcacaaagtcgaccatcaaccagggatagacagaagagaggaagctcctgctgactctgttgaatctgaaatgaagcgacgagtatggtggtatctggttgctacggattggtatgtgtcatcgcccaccgctgctcttgccaaagcccgttactgaatggcacaggatggcatcccaattccctggtcctcatagaggcacctacagcatcaatccgctacatatggtggtcagaaagcctcgcaatgttgacgatgcaaaacttatggctggttcccccatcattgaccgaccgatggagcaacccaccgaaatctcatacagccttcagcgtatcaagctagcggagatttgtcgcgaagtcatagactcttcttcgataaccacatacaatgacggagacatggagtctgggcggcttttgggcgtggaccagaggattgttacgttcattgaacaactaccacctttcttccgcctggacggggatgcccttgatgacctgatcgccaaatatccaaacattgcatcgggcattatgatccagcgatacatcattaattccttggtccactcacaacggtgccggctgcatctcccatacttagcccgcggcttggtagatccgatgtatgccccctcaagagaggcttgtctggaagcggctcggtgtgtcgtccaggcggagaggatgctagcaaccgaaaatatccctttcgtgcttacgagactgaagttctccggaatcttgcagtgcgttggcatcgcaattacggcccttctcctggacatgtgtctttctcaggagcccatacttcggcaggagcgccgggcggaagtagtcaatgcatgtagcattctaaaggacgccataaaagactcccccgttgcaatcaagctccttgagtcttttcagcgagttgtgcagaaacatgatatgtcggtcagcgaggttatttccgagtccctctgtgccgacagcagctcaagcagccttaccgacatcattgtcgacgaccaggacagcataccagtccttccccacctggatgagatttggcagatttcacaaatagatgcgaatatccaagcattcgattgggatgccttgttccttgaacttgattgtccaatgttgtcgagctaactagtcgagggggaataattcctcggtcatgccacatacgcttcttcgcagcctgaggcactaacagttatcaattaccagccacccagcccaatcacgtggcatgtatacttcaggctaaacagtaaagcaggcattgtgagtggatgcccatagctgcaatctgcttgcacatggagtgtcaaagacgttacaaagtatgatttctgtttcacgtagaaagcgggcgaagaattgcacatctctaccttaataggcaggaggcgtttgtgtgggatgaagccgtgacagagataatcaccggctccttacttagctagctgagccatcgtcatggttgcaatgaaatggtactcatttagtgactaattcggccttttctagcctttgcatcgttgaaattaggaccagaatatgggataatatccggttcctgatcctgagtcgagtggtacaagggaagagaagagcgtaaagttgatggagaagagtggggggcgggtgacatcatctgcactggggcggtgcaggctggcattaagcaattccccccaatggcccttctgcctgtttctccctctggctgcttgtttctccctcctcgtgtttcggctgtcccgcctcgaccagctgcaatctctcctgctggctggccatctctcccatcgcattcttttacccccagttgcacttccgaccttgcaatggccgccgaagaagatccgctcattcaggccctgccgccggccactgactacctgacctatctcaccctcctcgaataccaactcacccccgcccgccttcccattctccacaaactcctccaggatgaagtcctgacgacgaacatcggctgggacttggtgcagctgttgctgcccatgttgccccaatccctcgattgcctgcacgacattgcccgcctgggaaacccaagagaggtgatattgcgagtttccgatgcgctcatgcagttacaacccgaggacgaggatgatgatagcgacgatggcacggctaaggctgatgaagcgccgcaagatgctacggatggcggatcgaagaacgcggccctgccgcgccatatcttgcagttcaatactttagtctcgatgctatcggtcctccattcccgtatccagaccaaatcccccagtcggttcctagcgacatcactgcaggctgtactggaggcttataccctcatgcccacgaacgagacgacttatgcgttgctggagttcttcagagacgtttcaccgtccaaaagaccggctccgccacccagagtgcccagcgagtcgagcgtgttgcgtctgtcggagaaatctgcacctgatccggaagcagaggtccaatccccttccccggcaagtgatgatgaatcggttttggttcaaaagttcctacagttcggcctgatcgaggctctcaagtcatacctactgagctttactgggccgtcagacccgggtatgtcctgggcgattagactacaagagaaattgcaacccggtttgcgtctggcgaagcaggaaacaccgagcgatgcctttgccaatcataaagagctgaaagagagggacatgatcattgccaagatcacggtaggttaccgacaacttgcattctgggtttcactaacggccgcaggctctatcccgagatttcggtctcaatgacaagaaacttcttgaaattgccttgcaggccccgaaggaccagcctctccctcttgactttgaggagcctccaaggaaggcggacgagattccactagaaagacacggctccttattgctgctcgcggcgcgggcggctaccgcagaactgttctcatctggtcaagtcagcccgatcgtcatattccctgatttggcacgaatcttccaaaattttgttggaggatacaactctccagacgaagtggcattcggacagccccaagtgctgctggactctctgcttacgctgaccgtcttttccatgcaaaagccaagcgacacgacaccccatgagaaggactttgttgacttcgtgctgaccctgactgcttgcactgcacgccaaaattatagctccgtgcggcggattcctggaacaatcatccggacgcacccctcacaggtcactcaattcaaagtaatccgaacagttctggaagacgaccgcttccagagcgtcaaggatagtgcgattggatggctcaggactggtattctcgaagcagcaaactcatctaaagctggcacttcagccgagcccagcgtctacctcgacccgcattacttctcggtggtgttcccctccctcttcaactcatccgacctgttcatgaacgtatcatccgacctcgtggcttccttcatcaagttctcccagactctatccccctccatccacgcggccctcagcctctactacactatcgtatcgtcaccgcacctacgcaagcagctccagctcgaaaagacctacgtctacttccgcaatcgcttcctcgagccgctcaagtccctctgccatgccttcgaagccgacctggcgcaaaatggcggcgacgggaagatcgaagcggcggtcggcgagagcctgagccaagtaggaatggcgcgatcggttggcttgatctcatacatgctggaacaagtcgaagatgcggtcggggaggcttttgtggacgagtccgacctgcccgagccaagtgcggatgatatcgcgcgggtagatatgattcggaaggagacgtcgccttgattgtgggttctgtacatagttgaatttggcctgagggtttcaatgtgcaggcctattgatacctcttgctatagtatgatgagatagagctagtggctaaatatatgcaagctgctgcttatgttgatattgataacctgccgtgttgcaaacttttcattactcgtgatacaatgacctactaatcacagttgcagctacgcaatatcctacctttctccgaccacatacataccgatatcttattcccccctcagaacaggaaccccatcccacacatccccaaattcccccaaatcccactcccccacacaagagaaatcatactccgcctttcgaagactatctttctgcgcccgtagaaacgcgtccaactcgcaccacccatcactccggaacgaacactccggcagactcttatgtagcggtaccgtgcgctgattgagcaggaaatgcacatattcagtctctgccgtatgcttcatataagtgtcctggtgacgatcatggtggctacgacgcgggttaatcttatgtggggcgcggatgatctcgatgttaagacggccggcgaagggtatgagtttggcggtttggaaagcgtggtggcggggtgggaagacatccataaaatattgatcagtataatcaggaaacggaaggtcagcgaactggcgtagtccgaaggctgtgaggacaccgaggagaatcttgtcgtgtgcgaagtcgaagtagagtgattgattggttgggaaagtaactgggttcgtgttcagggtgaggttcgcagcagaggatgatcccggtgtcgagaacgagcgattctcaacccgtgctaggaattcctgtacccaggtgatgcccattgcgcgactgatggggcattgaaagcctgcattgccgccgaaggtgagatcgtaggtgtaggagaatccttcccattcggggaaggtgaagagcgagcaccaggggctgtagccgagggcgacggtttcgtaggcgcagagggtttgcgcgttgaagctgtcgttgctagtccagtggtagtcggtagagagatagttgaggtggtgggttcggtgggagaggtagtgggttttccattttgtgacggtgtcggatacgtagtcatcgaaggatattttcatggcgtttgggcaggcgtttttggcttggagggagctgttgaaattcttctcttcgatcatggcgagtaggttgacgtgctcgtcccagtctaggtggaagaatcccgctaggaagttctcggcgctcttcagcatgcggtcttgagtggtggtgcgcgcgactatcttagttcctggggtgtagagatggccgtagttgtagaagttgagaatgccgctttctaatagatcttctcgccctcgtgtggtaagcatatcagctccgaggctgtaggtccagtcgtggatgaatgagagttcgtctctgaatacggccccgtgggctgtagcgttggtgatggccttgatccaattggcaaaatcatcaccttcgtccttgttgggatagcgtgagccgtgtcggtgcagcatatgcatttgcgtgatgttcgagcctttggggcgtgggaattcgtccacaccgaatccatccgctcggggatagtagggactatcaggctatgtagctgcatattggaagtaagacatggatgaatgtacctcaagattcccatgtgatggaaaatattgcgatctttaccgccccggatgggctgcgacgtctccagcgggtggttggctgtgtaggtcgccggattgccaaagggagcagggttagtctgcgccagaaacggcgcagccccggtcgccgtgtatcctgatatgttagtcaggcaagcggacaagtacagagtcacacaccctgaaagctttgtggtcgggtcttgaaccattctggttctgtggtggtgggtgccactcccatcacatattgatcgttggccgagacacatgagacaagcagaagaaagagaatagcccagtaaatgcgagacctcatcgtgcaagaaaccccatttctgaaggcgctgatgtagatgagttcaagttgggaaatataaccagtttaaggggggtaggtagctatttacgtcagtgcatctgccatggacgtacactaaagttcggatgccgatgtcaccaactctgattggcactgggtttctgtgtttgaccctggatatgacggggattgagtaccgtgatggaggggatcccatatgctggaaaccatgattcgtctgaaccgtggatggtgtctccgcacttctgtttcttacctcatcatctgcccagtgctcgtttctgttattatcttatttcgaatcggacatgagatcactgaagttgagatactacctgtactaaggagacttccgtacggcatgttcgccattgtatactattctcaccaaaagtaggcttcatgaaccacattcagatgaaacatactccacgctcacgcagtaaatctctttcttgatattagtatcacaatatgagtgatattgatctggttgaaactggtggatttattgtttgagcactcgagggttaggttcgctctgaaggcttcagatgagcccaataagcattggttcgcagaattcattagtggatgaagatcgaaccggcacgttggtttccggtatctgcgaccgttagactaagaagcggtggctttggattaactgctcatgaatgtccagcctagatcgtcgcaggagagaagactcactctcagaaacagtgtggggaagccccaggactaatggtcaatattagctgcaagatagctaacctgggtgaatctaatcgaacaatacaacgtacacatgcggctgttatgcagccatgggaccaattacaactcgtttgcggctacgaagcctcattgctgtggctaagccatcgttattgggagtgtacatgagatgtgcatcttgctgcagcaaagtgggagtagtgtgcatagcgtcttggattgtggcttggtcggactgaatgtaggaagaatcagatctaggatctggctcatcgtggtcgtaattctaggtcagctagttgcagcaaacggagtccaagcttgagtatcccacgagtcgatcgagtttgatgatgaagaaaatgtgggacaggctctaaattcgtgctgggcacatgactggctgtattcgccttcgccttggattgcttgacttgctgcaacttccacgtattgaacactgattatgaaccaatactacctcatcaaaatgtagacaacaatacgcctagtggcctcgaacgtgagcctttctcctctgtgaggaatggctaatgtggcagacaacactattttcttattggtattcactcccagagaatccttcagcttcagcttcttcgggtccaggtgggctggacgccaccgcaatgggatatcacatgcagcaatggctcctggaacgcaaggcacaacccaggatctgatatgtctccggagaaccgcaccatcccagtgcgctccgtccgatattatgctcctatttgcaggtcaaccgcagagaccgggtggatatatcggaatcgtgcatacaccgacgaagagatgatgaatcccgcaagttgagctacaggtctggttgctgctgtagtccggccccctgaattatataaagctcgacgagacgcacaatcacctttcatttccatcttcatatttcaagtcatacaatacgcgccctgtcattcatcatggagtgctcagcagcctggatcaactcaacaaccgtcgacgaaatctctgtccgcaagtccggcgcgttcacaaccttgccagtgcggatcagcaagtacaatgaaattgccatcactaccgcgcaaaagcttgcttgtatctgggataccatgcgctgtggcagtgtatcttctcgccccatcaatgttggaaggaatctgcttcccttggttgtccctgaggccttgccggagagaacggcaacggccgtgaaactgatcgaattgggccatttgtgtgatggtatgtacgattcttgcttctgttgcacacagctaatagtgtagtcttttccgatcagctagactcacagagcagagcggaagtctacagtatgctgacccgatgtctggatcggtgctctgtagcttcgtcttgctcttgtcctagtacatgcaacaaagagtttggcgacagacaggctcagctgcggacactgatttatgaagtggccactgaagctattcagttcgatcgtgaacagggtatgctcatccttgagctccttgggaaagctgtcgcaccggagccaatgtcctttggatgcaggaagagctctgcgtttaggtacgtcgtcaacatgcatctctcagttgttgatttctaatatgacctaggactttctggcctatcctcgagtttgctattggtatgaagctaagcgaaatggaccggatactcctccgagacatcaagaacgtggttgatgaatgtcacatgctgaacgatgagtattggggtgcaaatgccactagctcaggagtataccaaacagactttggcagaatgccaagtctttctttcgaaggaggaaaggaaagtctgaaaagccggatcatcgacctcgaatatcgctaccgggctcttcaggcagaagtttgcgggaaataccctgttgagtccatgcggctgcgccgctggatcgaagccgctggagttgcaatggcaggctacaattactggcgtgctttatctgcaaatggaccttgcaacaacctgtctacaagcgcgtgctcctgctctccatccgagtggacacgggttaccactccggcctccaccatctcctactcatccagtcacacatattccggaacctacgatcgaggcgaatccacaacgcttaccgccgtcaccaactacatcaataccatgccaccgtcttcctcgatctagaccctcaacatgaccccctccgcattgaatcaatggacacgcgctccagctccagccgtccagtgcatttcgtctctcataacatctctatataacgcgatcacaaccctgactgatatcaccgcggacaacacccagcgttacaaccagcccactgcacacgccgtcttcggtaccatgcaggctagcaacagcgcctactacacctttatccagtcggtgtcggaggcacgcgccctggcaaaccctgcccttgcaaccgacatcctccttggtggcttcaaccgtctgtatgccggtcacagccgtgagctgacctggaagtacaacgcgtgcatcccatcggaggctgaatatctttccgttgtcgatgacaccacgggatcactatacacacttcttgtcaaactccttcaagctgaaagctgcttgccattccactgcaagcctgatcttactcccctcgctacgctgctagctcgatttgtccatgtcaaagaagactacctctcgttccataaccgggagagcaagatgagtggtttcagtgatgcacgcgtcctctcgtacccggttattcgactggctaatatcaaaccggacagtcgggcgcagatctctcgatacctttttgaacgcaaggacgcaagcaagagtagctgctcctgtgcagaggagaagaaagatccctgcggcaactccgtgaactacagctgcctggtgcttctgctacgcgagtatggggcactgagtgcgacacgcgaacttctccgtgatatagaagacaagattgagagggaggtaatgcagatagagaagttgacgggagaagtcaaccctttgatacggaagcttattgcaggactacgcgagggattgctgccataacccaccaccgcctatgttctcacccgccttcagcctacgaaggcacctacggagtatataagaaagcattatagaatcgaatataaatatattgactctataaaagatatataataaatatcccctccaatcctatcccgaaaactgaacaataacttgtccaaacagtaagttaaacatgacctcccgagtaaatagtatccattaaccaaaccaaaaccaccaacccaacataaaacccaacacccaaatagaccatccagtttccacaatcatattatccaaaaatgcggagcataaaaagaaaggagtcggaataaaagaccaaagacaggatcgaggttcaatatattgcaataaaggcaagaagttcagcgccacgtgcaacgcagcacaagagcatatcttcccccggtattatttttgatattttgtagagttattttttgatccgaaacgaattgcgaggtagataggtaggtatgtagagggtccgagataagcggccatgggtctcttttgatgttggatttgaggatagtcacagcgaacatagactattctttcatattattatcgattgacattgcgagttggcggtttggttggaaactttaacatgaaatggaagaaatcggggttatctcgtggttaatgcggagggtctttacatgaccacgcagccgccaccgggggagccggctatatcatatatatctattagctttgcttgcatgaccatgtatatcatattctcatgtatgattaaaatgaaggaagagatggaaggaggtaaataccgcaagagactgagtccttagcaacttcgtagggagacatggtgatagatagttgatttgcgttgcaaaaagttttctttttggaatgcttgttttgattttgtgatgaggaaacaagatcgaggtttgaggggagggtgagggggtttatatagatattttactacgtatagttcctctcctgctgggagggagttcattgaagtctacattgatggatagtatgggtctgtgtctgtgctatggggtagggcaccggtccggattcatcttcgtgcttcatgattcagggagtgcgtttgattggattgagattcattggattcggattcatgaatgaatgaatcagtgtcacagggtcaatcctccaaggggataggtgtaaattaccattgcaggtggttgatttgatcggagattgtcagttgggattgtctggcattacttcaggacccctgatttgggggtgttctagtgaatactagctatggctttagtttggcttctattgttcctggtgtggaactagtcctacagaagctctatcaggaccaggggtgagataaatgaatacgaaaggtaccggattcttgcggctacctgctgagagagactgtctgcattggggatggaatgtagaccaaatgaaggtgttgtgcattgtatgcaggcaaatgcagtacgcgtgggtacatcatccagtctagagctgaaagacatctttcactttagggcacacgaatagcttgagcagacaaacatgcagtcaggtgtttcccgaactcgggaattctaggtgcaaagttagtcgacaggcgccaatcagcactagccgcttagtattgttctcgagaacaatatcaagaacatcaaccacacttcatccgcttcattcaaagaatcaaattcatggctagtactccctaactaacaaagcatgacaactggtaatcggcttatctcgtcaaatcaggtgtagatggccgtcaatcagtcaatcaagtgtagattggctccgtaatctcattcagcgtcaacccctccttcgccacatcctcctcaatcaggaacatcaaaggcatctccaccaacgtgcccttgacctggctgagcagttctttgacttgcctgacaccctccgggcccggagggaagtcgtcgcggaccacgtgcccatacttgtagcgagcaggtctggactcgtcctcgccatacgcctgcttgtccgcgttgtggaagtagtatccgtagaactccttgtacgtagcccagttgcgcaccgagtcgtccggaaccgagtggaagaccttgcggaacacctccgtgttcgtccgagcccgcgtgttccacatactgtgcagcgtatccgccagcggatcggccacaatctggctctcgggtgactcgaagtcggtggtgttgggaacgcccactggctcgaagttgccgtccggccgctccatgtcctgtggtggcagcagtcccaggtgcttgcggaacagctgacgacggagggaggtagcgaaccggctggcagtccaaggctggccgttcatgcgggactgcacaggggtgtagtcctcaatgacgatggcaatttccgagtcgtgagttcccagttgagagcggtcgttcaagttagccgatccgacaatggcaacacggtcgtcagcaatcatcacctgcatcttgttagttctgcacttataccatgtgaatggctaacgtaccttggagtgaacatagagttcctcggtgacaaacgcatcaatctcggcctccggaggtccgttccagggcacattgcgaatatcagggccattgagcatgtagcagctgctcacactatcccactggccagacttgccgcccacctgctgggcagcttgctggtactgctggtaaggcgcggtggtgtcgaaagctgcccgcggagcaccaggaccataaccaccagggccgccggtagtcacatcgtgctgtttgcgggcatcctcgtaattgacgccgctgctctgctcagcctgcatcagcgggccgctgacattgatgcggtcgtagttacgcaggttatagaaccggatgtagtccatcgggttgaatccctccttggcaatcatctccatgatgctgctgcctccgcggttgatgcagttgtactggaattccatgatggcgcgggtaccaagggtggattcatcgctcaaatctccggcaaagcaggggacggagggaatcacgacgatgatcttgaacttctcaccagcacgggcagcgcgcagaatgcgctccacaatcgcaacaccgatcttgttctccaccggcttctgcgcgtcaccggtcgctgtgatgaagaactggttctcaatgtagataaagtgctgactgttgcgaatgaccgcagcatacgcatcctgaatggagtgctcggtcggagtgccgttactccacttcgagcagctgcgcacgatctggcaggtcatgttaccacggggctggttaacctgacggccatgagtggagaaccgatcctggtactgatggatctggcctgccaactcgccacgcaggacgttgccgtagtccatgaagttctcacgcagacggcgggggttgaagcccctctcagagtcgccatatccgctctggtgcgcgtcgtgaataccgcgtgtttgcgagtggtggacttcctggttcgggggaggcggatagtaaggagtctgactctggccttgggtgggtgtctggttctgaggcgacggctgctgggggttgtacgcctggtaagacgcctgcacagagttctgggctggcggaggaccaggagggggtggggggaacgagtcaccactgtaagtgtagtgctgctgtgggtgggccgagtacgcaggaggctcagagctctgctgttgccagctgggcttctcctggctgccagtggtttgtgcctggggttggtaaccgctgggctgcgcaggctgctgttgccagctgggcttctcctggctgctcgggttgggggaaggactggctgcgtagcctccctgttgaggtgtcggtgcctgctgctgccaggtaggtgtcgcggggttggcagtgctggaaggctgagtgttgctggcaactccggtctgctgctgctgccagcttggggtagaagagctgctggaactaggtgcctgggcgctaggctgcgacggagctgcctgttgctgccagctaggagcaggaggaccaggatttgccccaggctggggagacgctgcctgctgttgccagctcggtgggggaggcccagtggcaccaggctgaggcgacgcgggcggtttctgggcctgaccaccctgttggggcccttgctgctgctgggggcctgaggtcggccggccgtacagggccaatctggcgtatctcgagttgttgcgcgactggtacttggagtcatagatgaagttccaccgctgaacaaagtgcttcctcagatcctcgacgaccgggccgtgcaaactgaccgaaatatcggaccagcccatgcgagaagtgtccttgcggtccagctggttctgctcccagtgggcaacgtcgtggaaatcactcactcgggcgttgttgtagtcctgaccggggaagacaatcttgttcaggtcctgaccgtgaacatcggccagttcatgctggttggtgtcccagcggccaaagcacatatccagaccacccatgaacgcaatgcggccatcaatgaggcaaagcttctcgtggtgagcccagtacagaatcacatcctcgtgcatgccgtagatgcccttgatggcgtcttcggacatcttggcaaggttgccggcatcgagggacaagttctggagagacgtatggatggacgcctcgagttcctgacggtcgggcaggtgatcggggtgacggaatactgcaatgttttcatggaggtcttccagatggtgcttggtgtggtgtgaggagactgccagtagggtcagtttgacggttcacgcaacagacgcacaaaacatacgggtcagtgcctgcgtcacctccttgtacacaatgatgttcacccggactccgcgctgcgccgcagccaacagcatccgatccagccggtactgttcgtgctttgcggggggtcgtctcaggtaaagttccggagagagccaccctaaaatgcatagtcagtctcatgcccctccaacacagcagtcccctgggtacctacagtccagaatccaaatataatccttggcactctccaatgccttggacacagcataaaagtaggcgcaaccatccacgtgccacttgacctcgttaccctgacgcggggccgcaaagctcccgaagcggttctcggtctgcggctttggagcgccatactcggcatacgcctgggggtcgagcgcggtacccagtttctgtgccacctcattgccgagttcttccagcttgccaaacaagccggaaaatttgtcctgcttctgcggtttcgacggatggggttgttgctgctgttgttgttgttgctgctgaggatggtattgctgggactgcgagggaccttgggactggtaggtctggttcgaagtctgggagtttggaacgggtcggttagtaccggggatcggggaggtgaccaggtacaggcaacaacttacattgtagtagctggcggactgggattgctgcgactgctgagattgctgggaagagccctgttgcgactggtgggacttgtaagtctgcttcagcttcttaaaagtgtcgctcagacccctggaggagtctccggaagaggctccccgggcggagtcctggtagtactggccataggccaggtcgtcctcggggcgggtcatggtacagggaacacttaagtagttaaggatgaacgaagttgtcagagaaaggtataacagataatcctcacagaggattactttttgaggtgcagactaccaagcacccaggggcgaagggaagctattagtagtaggaatgggtggggggtggaggggagagagggatcagcccagtggattgagcgagtggagaaaagagaaagagagtggaagatgatgatggagggcgcggctgacggactgacgacgagccccgcccctccaagactcagtcagtcattcattctcacaccaactgcaccaggtgaatccacatttaggctgcaattattattatgatcaatcccgaccggtgattcattgctttttgcccggggtcactggaacatggtggtaaggctggctggtcgtggtcgtccacacccggatgcaacccctccatggcattcccacgatctcgatcccaacagataaccaactaatcagtctagttcgactcggggatgcaggctggccggctcagaagtggggaagaatggcgcgaatgtgccgttggtgtggctgtgcagtcctgccaagtgtctcttcagtcttaacggtgtgcatcactctaaactagtgggatggagtaggggtttcacttggtagcggtcaagcgcaggctaatactcactgggtaaggaagatgttaataatatcatcattcatcagactggaattgtaactacctactagttagatactagactagatactttgtatgaagcgtgtatccagattagacacgtgatgcctacccgcccggaatgttgtggctcaggcggatctctcggctgccatccatcagccatgcatgcatccgacaataatagtctttccggagcatctcggaaaacaaggctgaactggtgagggaccgtgaccaattccagcgtgacaaataacatcctcattggtctgataatatgtacaagtgtggtaaccatctctacttcgttcggatacagcgacgcaggtactctcgaacacgatccacctcccccagcgccacaactattccaacatacccgtcgggccggacaaccaccatggctccctgatgagggtccaccccgtagattccatacgcatcctccagctcgcttccgttgtagaagcgcatctccgcatgctccttcacgcacgccggaaggtcgtcccattcgaaatcattcgggagctgcgggtgcaccacaatctgctcgatgacccccgctgggaaagttcccagcaatgcagacacatcctgcaatgatcgagcagacgcgctttgggcgttgagaagatcatcggacgtgagcgtcaggacgcgaaaccggcccgttgatgccaggtctaaacgtgtggccatgattagcatatgcaaggggtagcggggatgatgataccgaccatcctggatatcccggtgccatccatccgcatggcgcctcaatttcacgttcagcaatcgtctgcccggtcgcagtatcccggacaagtaatcagtgccccggatggggctatcctgtccgtccgatgccgttctgtcaacgatcatactctctccatattccacgccgcagccgctggtaaagccgttgccggtgttgaatgtggccacgaattccgcgtgcgacatccctgactcctccgtgtccagttgacccgagaagatggtagagaacttgcgatcaaaatcaatcagctgctgcgcgttggcatgccgttccagatgataagtgtcgagaagggggtgtggctgtcctggctcggcagacgctgggctgagtccatggatgtggtaggccagcttccaagcgaggttataggagtccatcatggacacattcatgccttgaccggcctagacaaagattagccgcgtctcacgattagttggaatattgtaccttggggctatgggtatggcaagctatggtcattagcattcggtttcagtcctgagtacaggtgcacataccgtctcccacaatgaatactctagggactccagcagagtccttgacggtgaactctggcgaaacccgctgtccaatttgatacgctgcccaccagtcgatagattcgtcactcttcggcctcaggtaatatggcttgaatgcgtccgatgcttgcttcaagataccctccttggtcaccttctgtctgcgtgccctggcatcatcgaattctgatactggggtagcgcccaccgctatatcgctatcggggtttgccattccaggcacctgtacataaagtcgggtaagatactcccccgtcacgatccgttctcgtggaatgaccatgactgagccagccggagaatgaatggcacatcgccgacgaatgtcaggaaaattagtgtccactaccaagtctataacgccccagatatggtcaagcgattgaccctctaaccttaaccccatacactgacgcaccatagaatgtgctccgtctgctccgacaaggtgctttgtgcggatcaatcttcttactccgcgggtctcaatctccgccaggacgggaaactccttgtcatcttcgttcagctgaacatggactaacttggtgtccctttgcacccctcttttggaataccgtaggaggtcagtctccatgatccgttcaatacgtccctgatgtatagtagcctcgtagcggaaccgagctggaggtatcacttcaaagaccacggactttcgctcaataatcttggatgggtccgatgaggtattccagaaggcaaactgccacatttggcatgcctcattctcaatttcgtccgaaattcccaatgtcttgaacacctccaacgtccgaggttggacgccatcagcctgtccagatttcaaggtgcttggcttcgaatcaatacaaagcagagactcgtcactcaatccgtatctggccagcaagagttccagcatcagccccgagggcccagcctgcatgacgttatttttctcgctcgtgcgtgttggctggtttcacccgctgttcaaagggacttaccccgacgatgacaacctcataccgctcgaccccatcgtttacggtgggttcgaatggcggagtaagacgaggtaccgggagagaaaaggaaggaaggacgcggaggtcccgcgatttggatgcatattctgtaaagaccggcatttcgatgtaatgcttagtttgttcacttctcttagaacaacatactcggtgggcttgtagatctatatatcatctctcatgggtgaatattcactcggttgttgaatgcggcatcgtctggagaaaccccacacatcgataccccacaggtgggaagaactctcagcgagcgacggatgacccgaagtgcgccatgtccagccgcgttattgcgcacgtatggggtctccagcgatcctgccggttatgttatgatcattagtatgattggcgggttcactatgcaaagcgtccaaccagatgggatgtatatgcagttcatttcgtaagtgatctcatcatcctcaggtaagcagtctgcaatccccttccgagtgtcgatccacggggtcaccccgccaccccgcaacacatcccacattcctgcggggaaactccccgctgacctcggcatgaaccatttttgcattgtgtcaacgccttgttgccacaaagtgtttcattgatactttcttttctccagcggtcgtgcataaatgtattgctatagcaaccgcaatgaaaggtacgtcattcttccctaacctcttccaaagcggtgcacagcacagtggcgaatgttttggagatcgtccagcgcccaaaacggtgcagaaggtcaatcagtcgatgtaaatgattaacatctgcaaatgcagagtctccaaatgcctgcccttgagcctcctgcaaagcggtctcactgcccaggagctggatttctggggcatcaaaagctttcagattgatggattgctgttgcccaattctcgtgaagcagagccatgcgagagcagcagaaaatagagccccgggaacgtgtattgcgggttcagaggaaatccgcatcctctcgaggtaacgctgtatcaacagcgcatgtaccaagcacttactggcatccagggagcctgcccacgtttggactgggtcctgagatccagtggcagctgcatgcccattacgacccactgctcgttcaagcaggtccatgtcgctgtaaagagacatgtaaatcgagtgccacaggactggaagactgaaggggtcctcttcctcattctggatgtattgtaggctatatttactccaccaatgcattagtaggccagatagattatgtgatctacctctatctagggtgcctgagaggcgagcctcgataacatgggcgtttatactctccaacacactgtagatagcaaacctggaatcatgcccggcggagtgaaagtgaaggtcggggctcaggcttaatttggtatatgacggtgactgtttgaatatatcggcccatcgggcggctgtcggggccatgaacataggttcagaggctagcagcggatattgtgagagtcgatgtttgcgaataggttcatggtgcatcagactagcaagctctgcgtcgtgtatattcagggcgatttcgacccgtcttctctgttccgcctcggcccatcggtgccactgctcgatcagctcttgttcggtcgaacagtcatcgagaatctggccatggccaagagtggcgtatttattggactcgcgagcccatcccatcacagtaccatgcaggacatcagccaggaccaagtccttgggccttccggacaaaattccataagtctggcccagaatggcagcttgcaccatcgacaaggcatccggttggctatgggccaggatggcctcccacgaggccagaattgctttgttcagtctttcaaaaatcctcaggccttgtgccactgcatgggatgaacccacaaagagactgcctattgagcagattgataagaatagcaacgaattttccgcggtcggacggaatgtgggcgcatgtatgaccggaaatagagagtggaatcgactgaagaagagttttgcaaagaggttcaattgctccgcagagggcagtgcttcatcatgcatgcggggctttagcctctgggagagaccagctctatagttgtcatcggcatcaatcctcccttgagggaaggagtcactgggacgattaggtcctctgtagacgaaatgattcacctctggtggagacaagcaggtaaaccatctcttccttacaatgtctgctggacgaggatcattgccgttcccctttgcgtagggcgttggtacggaatgcagcggctcttctcctaagccaacagagcctaacatgtgtggcgtggaaggcagttgcgcccattccgatattgccgatgagatggagaagtccaatgcattgacatcaaagtctgcccccaggaaccaagaatcggtatctgtttgtagcacgggatcgtgaagactcatccctaccgctgattggggttgagatggttcagtcccgccaatcagttgatgaggtacggttggtactattaacgaagcatcattgagtagctcatgtatctttggtgccccatgcgatggggtagtgattatagtagattcttcttccactgaatgagatggcgttcctgaactcgaagctcggggctgtggagaagcactttgaggatttttttcgtggcttttcaaatgccgtcgtagcacatcgctagcaattgtcagcataaacgctaatagttcaggctcggagtgcacaccttcttgagtacacctttccgcaggtggtacacgcatacggtctctctttggtgtggctgcggagatgccgcgtgagatgttcggcttttgagaatgtcttgttgcaagcaggacaaggacgcgtacgtgggggatccgcctctgagtccgaggcgcgcttcattgcaggccggctctccatgatgctctcaagtatacttatacacgaggattcttaaccggtgtagaagaggcggagttgcggagttgcggagaaagaacaaaccccacatttgcagtgggcacgtgacttattgattcacgatagagtgcaaagtaatcgacagtcaaactactagtgattttattcgtagctaaagggttggaatagggttacctgagctcatatctgctagttgagtagttactagtactataggtttggtgcggaacctgctgagcatgataatactatattttgtatttggtactagggccgaatgagaagactatcaccggtagcatatgttgtataacaactattgatcacgacgaatctgctactagtagcaccataccgattggcaactacagttacaaattacacctcttcagttcgggagagaccaatatcttaagatacatccactgatgccagtttctcgtaagttcagacaattccagttggtaggtactagctatgacgaaccaaatccaagttgagtctgactacgctgcaggaagtgagcatacatattcctgattatttccaatagagtactaaaatctctattcttttggtgttctgttacagtatgtctcctctcgatactatatacgtatgctagatgtcatagttgttggcaggcggttgcttgcggatccgacctcggcggaaccccgcagtatcttatctgagatgcacctgacgttttcacggctacacgaagataaggtgaactccatagctttattgagggtgctgccagcgctgccacctaccagcgagcctataatagtgctacttcaccaagaacctgaaagatgacacaaacgtctatagagaggcgaacgttttgttgatgcaccccctcacagcatgagcccccaccgttgcagcgagacggcaagtaccccgcaccatagttggagaaagcggatcaccgccaattatttaagaatgacacccatccttctgcttgactttggcagctagctttagaatccaatcttccgcagtcttagtccccttgaattctttccattgccgtctctgcccaagcatcctaccgacacaatgtctctcgccacccttgacgtaagtcctccctccaatacgttgtgccaaaaacagaaacgatgagctcatcactgtcaaataacagactgcccagcatcccagcctcccatccgcgtcggagaccctgttcaaggccaaagccgccaagaaactgagcttcgagcaaattgcccagcacattggccgcaatgaagtggctaccgccgccatcttctatggccaggccaaggcttcccccgaagacattgagaaactctcaggactcctgaccattccatatgatgctctggaagaaaggcttagtggcttccccgaccgtggtcgcagcgttgagatgcctcccaaggagccgttgatttaccggttgtacgagattgtgcagaactatggatacgcgtacaaggcggtgctgaatgagaagttcggagatggtatcatgagcgctatctctttctctaccaaggttgagaaggagacggatgcggatggaaataactgggctgtgattaccctgcgtggcaagtggtaagttgtcttggatgattgatggtcgctggtgatatactgacgtcggtaggctgccgttctcgcggttctagatcgggcttaatgactgcatatataggcttatgtaaatgatttgctaatgaatgttttttatgaattatctttttgtagtatgtggccagtgggcttgtattgactagctgtgggtacgaagtgagaggaaagtgataggattccgttaattcaaatctcacttcaatgccacctcattccatgcaatatatgaaccgacttgtaatattcataggttaaataaaaagccttccagcatctactactccgtctcgcttcaagtgcataccttcctagtttggcaggtcacatatagggtgacactcattcatcaacactacggtgaatttcgcagaccttgaactttctactcttcttagctctctgttgagacctcatctcgcttctctcaattattcggacactcgccctacatctacttgacgagtttctggacgagtccaagatgtccgctcacggatcctccaccagggtgccctgcacctacaaggactgcagcggtgtctttggttcggagtgggacatgaagaggcacaaggtgaacgaacacgactactgcaagcgttgcgacgaagacttccaggatgatgagtatctactgctccacaagatcaagagtgacaagcatatcgtgtgtgtggtgtgtgggatcgatttccgcagcgagggtggtagagacctccacactcgccaggttagtatcattcattaccacaaatatttaccatccacattatattcaagctaatacttttggtgtctatacagcaacaccgaactccgcagagcctgatctgttacggctgcgggcagaggttcagacaggcaggtgccatggtaaatcacgttgagagcggcgattgcccaaacatccccttgtctagtctcctacaggaacagtcaaagagactcctctaccgggagacgctcaagacaggaaatgagaatgagaacgctgaccccgattgtccagatgacaacggcggagtccaaatcgagcagaaccttttggagatggactttgacaacgacgaggccactcgatctgttgtggacggggtgggcggtctatctcttaacaccaacgtcccagaatggaagagcaagtcgtctatggcctctccgtctatgacgagtgagatgagaggacgatcagcatcggcggggaagatgcctgcatcgggtgccaggccatcgagcccaagcccaagcccgagcaattcatttggcaatatccgcttcgatgcaggacacactctgcgcatgttggaccagaactgggaccctaccgtatacttcagttccttttccggaaagtttatctgtccctgtaaggctgaattctccagcatgaaggactttgaggagcatgtggtaacgaagaccaaccagaacaggagcattcagtaagcggctgcatgcttgcatgactgttttgtctatggtctgactcacggcttattaggtgccctggatgccttcgcgtcttcaaaacggcggctgccctggtggctcattgcgagtcggccagtactcggtgcaaggtgaacaaagggctccatttcagccaggtgatcaatgacatcagtggagggctggtcaagtcagttggtcatttcgaggacggaagcgttgagtatggtgttggcacaatgggtccgaagaaggtgacttataagaaagacgaggagggtcctaatctgatggactgataaatcacgaagatctagtttacaatattcgcagaggagagttagcgcgcaacaagactgccacctgatgaatagtattaatgcaaatgtgatctacagcgcactggccaaccgagaaataagcattcatcttaactcaattcattcaaagcaccaagcgaaattagagaaatcgtagatgggataaatacaccgggtataagcgatctcgcaaggcaaatccaaaatcaactgaaacaccatccatcattccatccatggaatcatcgacccaaaaatctaatccacttcatccgggtccacatttcatagctcgtctcgtagatggcacatgtccgttttctttaagagggtattcttcttttatctttgttgttcgtcaagatacggagacagtagtcgaacgtatgtatgagagggaagggaaggtgtttagcagcactcttcgcagcactcgaagcaaaggagaccggcgcaactagagaataacaattagcttgactatcatgatggcatagagaaaggaaagaggggaggaagaacatacactccgcagcacacatcaccggcaccaccaccacgcaggcccatcttcatttcttcctgggagttctgcagaaaacaaatcattagcttttattccatataatatgagatacatatatggtgaagatatgaaacgtacaggctgctgcgtaacaacgcgctcagtggaaggagcctcggggctagaaggctgctgcatggtcatggtgttggcgtcccaggagggctgctgggtagcggaggattcctccttggaagacttgaaccagttgaagaccattttgattgatgtagtagtgtaagagtgttgtgtttgtaaataggtgagagtagagataagagatagagatagatatctaagtataagcagataagtctgactgtagtgtaatggagatgagcgaacaaaagaaaaagagaaggacaacccgctatttatgttttaaagatgatcgatccatcatcccatcccattacaagtctctggatcaggggtccacgacccagcccggccaggcgattcattccgtgtgggtcagggtgtaagcgcgtatcagtggtgtaatgatacgggtgggggccgcgagagacaccaaaacagaaagtcctcgaaagaatccgtcttttttcatgctgagaaagcggggaggttggttgaaagtgcaagaatcagccactcacagccacgagatggtccacgtcaacccgctcagccctgccggctagtactcttggcacggccgacttgtttgtcgtgggattcgccggattccatgttgggatggttgttgactgattctccgctgtcttggggaggtgttgtgccgggttttccgtggctgggctgtgtggttgatgaaacttgggctgagttgtgcttgcttgcttgtccataattgggggggtgttatagacgcgcggttcatgcagagaaccaggtgaggagctcggatgacggtgtcaagtcttgtttctttctccttctctttctctttcgcggtggttaatgagctatgatggatgcttacttgcttattttgcttcgcttactgtgaactttgtaactctgtactccccatctgatacgtagtaagcacatttgggtatagtagttatcatccaacttcaatagtcccgtaactttcatgtctgtcccaaaccttgaatccgcccaaataccagggatcggcagctaaccatactgctttcgctccgtcgcccgactcaattttggtcagtcgaaacgccgcgttgcttctgtgctcttcgtcaatccgaatacgaacaatcccattacacatacattacattacaacagggcagtctccaagctttacctaagctttgcttggatgctgggccaatggggctgtgccaatgctgatctattcttagcactatcgcctaaagggtcctaggcaacctcattttcgtttttttgcttaccgattccccggttaccggacactattaccgagtcagattgggccgggataaagatactgcggcagttactcactgacaggatatggaggatgagggtccggttctgtagaccgttgggccgaccgactgttccatggtcccttgcattgaattgcgagtattgtctgtctgtctatcattgtaaaactctgcagggtctattactagtactcctactgtatgagggagtttcgcttttccattcattgtcattggttggctgttcctggtaggaactggatagcagtctcatagccgccgtgacagtgctagtcgttgaagtggtttgttattagcttcgtgggataatgccatcccatgcatctaatctaatagatcactctaggtggaacattgtggctggggctgtgtatcaaggtgcgacatgagtaatatggccggcggatggactattgatcaaagccacactccagacagggacggtcgcagagttgacatggatgttgtacttacagagaattacaaacagtattctattccctagcgtatgggtctgctgtcgttgagagaactgctctgcctatcaatctatttcagtggtgacagcttgattggtgctcggaataagcctcagaagatcatcctgcgtgggtatctggagtatggaggtgcctgttcctttcctgttatccactcgtgggtttgccgaggtagttactgcggttcaataactagaatgcataaatagaatgatggcttagctgtggtgatgctggtgcctgtcacagcagtggcacaccgctcacatcatagttttttgtgatcggcgatgtgcagcattctattatggagatctttcttgtcgatgcaatgtcttggggtcattgtgctggatgcaacagtaggagatagctgcctagcctatgcggtcaactggaggacgatggtacttccattgcgacatttgtggatgatggtcgcagaaggtttcacgagggagactgatggtctgtgacattattcgcatcagaacaccaacaaggaagcctttaggtcataactgatgaacatgaggagaataaaggttgattgtctgtagataccctctgcctgaggcttatgaaggcagctataccgcctgtcaaaaagctgactgagcttctagaacagagaggaacgaatggcttggctggaatgcgtgccgtgtagtagacagtcgatgacgtcccgtgatttcaatcaccaccaaatagagatccatgaacagtgccaaccaatccacggcaccagtagccgtagacattgaatgattatttcactcaaatgtactgcgaaatagatatgtaaatgatgatggtagtctgataagcccatcccatcccattccagcccgatcgcgaattgcaacctacgcaaacaaccccacattgcggggcagaaagccattccgttgtcgcaataccaccagaaactgaagaaatattccctcttcttcttcacatcactcccctttttcatcttcaatttcccactcaatccacctcatcaatacacctcaaaatggcaaaaacccccatcctcattctcgacggcggtctcggcacctccctccaagaccactacaacattaccttcagcagcagcaccacccctctctggtcctcgcacctaatgatctccgacccctcgaccctcctctcctgccaacgcgacttcaccaccaccgccgccgtcgacgtcctcctaactgccacctaccaagtctctccggagggcttccagcgcacaaaaaccccttcccacccgacgggaatcccccgcgagagtatcgccggttaccttcgcaccgccctcgacgtcgccggacaagctgtgcagaatacttccgcctccgtggcgctaagtctaggtccctatggcgcgtgcatgatcccgggacaagagtatagtgggaagtatgacggggaacatgataccgaggagaagctgtggaggtggcatacggaccggttgggactttttaatgatgaggcgatggaggggatgaggttgggagagagggtgaagtatattgctatggagacggtgccgaggattgatgaggtgagggctgtgaggagggctgtgggatcttctaggttttgtgaggggatcccgttttgggtggcttgtgtttttccgattgaggataaggataccctgccggatggaagtaccgttgatgaggtggtagaggcggcgttgttgccgattgaggggggtgctacgccgtggggaattgggattaattgtacgaagcttcataagttgccccggttggtgaaattgtttggggatgctgtggagaggttgttgagggatgggcgtattcaggagaggcctgcgttggtgctgtatccggatggcacgcagggggaggtttataatactgctacgcagacgtgggaaaaggttcaagataagagtggtgcggctgattcggtaagtgaaccttttggatgttggttgtgatattgaagagatatatgtgctgactgattagcgaccctgggaggtgcaattggcacaggtggtcaatgacgctagcgcgactggccagttcagctctatccttgttggcggttgctgcaaggcttcgttcaatgatatcaagaggcttcgcgaacagctccgcccgcaataaattaaaacttgtataatatgtatatagaaagtataagacttttttgacgggttgcaaattgttgaaattgcatggaaaacataatgggtatctccgccgaaagatgcacaaatgtacagaaagaaagttgaatttggaaccagtccacacttagaagaaccagtccacgaagcgtctcacacgggtcttgggcccgccctctcggataacaatctcgccctcctgcagccgaccggaccagaggtcgatattggagctgcgaacaaactgcatcatcagttagcaacatcgttcgataccagggtgaagataaggctgctcaccttcgtgcgcttgaacaccttccagaggataatcggcacaatgaagataggaatgcccacatatgaggcaaagaagtccgaagtggaccagttacccttgaggaacacagggaaacccgccaccagggtgatgatagttgagccaatgaaacccacccacgccgtgtatggctggaaaggcgactgccagggcaaagtgtcccggctgacgccctgcgctttcatggccgaatagaagcgaatgtagcagaaggacagcgtcgcccacgcgatcagtccagcaatggtgctcagattaagaagccagctgaaagcctgtgccggaccaccggatccaagacctagaaattccgttaatcgagatggaaacacattaggagatcgatgattactaactcagatatgccaacggcccaaaaagccaggaggtgatgacggcaacgtacggcacgcccatcttgttaacccggccaaacacctgtggtaactgacggtcggtcgtcatggccacaatcatgcgcgatcccacccagcaatacgaattgcctgcagaccaggccgatataaggatacaagcgttgaccacagacggtaaggcgctaattccggcctgcttgatagcaatgacccaaggggagctgttggcgttgtcggaaccagaaacaagatctgggtttgtagggctgacaatgattccaatgagcagtgcaccgagaatgtagaagaacgcaattcggtatgtcacgcgacgggcagctttggggatggagtagtgcgggtcgaccgattcggcggcagtgatgacgactgtttcgacaccaacgaaactgaaggacgcattgacgaaggcagacaaaaatccaaggaagtgtccagtcgggccagtgatgccattgtagttcgtccaggctccgggattgtgccagtagcggaatccgatggtttggtgattgggaccgccacctgaggtgatgacgatagcgacaatgaccaatccgacaaagcacaacaccttaatagcgcctgcgatgacctcactttcaccataaaagcgtacgctcatcaggttgatagccaagatcagcaccagcccgaccgtaataaccaccgccggtgtcaagtctgtccaatagccaacaatgaccgcagaagcggacacctctgaagcaatcgcaattgtataacagtaaccgtatgtgatagcgagggaaaagccgacggccggatcgatgaagcgagtggcccagtgagggaatgatcccgctgtgggcagcaaggtagccagttccgcaatactctgcatgacacaccacagcacgaatccaataacaatgtaggccagcagcaaaccagcgggacctgcttctgcatatgcagagcctgctcccacgaagagaccggttccaattccaccacagaacccgatcatgctgacctggtagttcttcagccgccgttgggtagcaccacggccaccgacattgagctccagctcacctttgagcgggggagcttcatcgtcgtagttgaccacctcaggaccaccgtatccgtactcgcggatcttctcgtcctccatggtgacagtggtggactggtgcatcttggcggggaagatgcgaagttgtagaagtggtgacacaccagagaagagaggttcccccagagttcttgtaggcgacaacgacagctcgccacactccggccacgcgcggagaaaaatgttttattcgccgctgggtacctgcatcgcgacatcgggaaccacgttcgcaccacttgctcgtgcttctccacccgtctcgagccatttctttggttggacacgcggcaacgaaccccacttgcacggtgtgattgagtcgaagttggagatggtaattagtcacagaatgctgtgatactggcagcgcctccgcacggcttgaggggagtcaattgctgggcatctggggctctggcagacatgtcttggctgtcctggggaagggaaagacatggtgaccgctgaagttctgagcggtaaacttccccgtgtctcaatctcccctgcgcggcgaaccgacaattgactttgtcgatcgttcaaagtttttctggaatgacgggaggaacctcatcccggatctgtgtgagcacgtgatgtctgttccaccagactgagtaggagtagccctcgtcgggtctgtttcgggcctagtctccgcataatttcgcttagtcatatatatgactgtcacaattccgtcttcggtgatgatgaatagttaactgcagcttcgcatcatatgaggacattctcaagactgtcggcatcccaagttcccaagggcagccggtgggtttgggcgacacgccatccacaaaccttatccatgacgcaaaagttagcgagtggagaaagattccgagccgcgaatatcgaataatctactatccatagctagtaaccactaaggcgaagctcacctctagcgtggaatttgagagcccagcccgtgaatagttccgcaatggctgtatacacacattttggcgagagaatataagatggtagattgagtgcactccaattgccagaatatggcagggcttaatccacagttcaatctggatggaattcagtgaagtaacagcagtgaatgcgatgtgtttgccatactatcagagagctcttaatcctggcgctcacagagctaccctatagatttacccaccagttttgaattcatttcatgacttcttctaggccatagtattgctcctgaagatggttcggtagtgatttgtaaggtgactgatacttcgaaccgtatgactctcgctaatccgacttaactggcaatagtctcaactaaagacatcagcatgacaagttcctcaaaccccttctcaggtggtactggttggctaagcagccagaaagacacagaaaccatgtcgtccgtagacagaggtgacaccgaacccgatacctccagcgacagcgacaaggatatcttcgtgccacctattttgagaaaacagccatcccagactcaagatcagcatcatgtcaacgatctcgccagggacacacgcctgtccaacgcgttctactcgtcctcaggaaacagggcagacgaaggcgcgtcaccgaattgcgggcagcaacatcagcatcagcaatctatcgatactaatatcgtgagttcttgggccatcgccttcgggtcttcagtccaagttcaggagggtcatgcccagacgaatctcatcggagacctccagtttgacaaaggtggtgacacttccacatcgacccgccccccttataaacctttcggtcaaagaagagcgaaacgacccatttccagcaactttcggaagcctatcagaggccgtccagatagcaacgctcgttcacacgatgctgatggggatgtcatcatgagggatgcttcttgaaaggcagattagttttcctagcagcagagttgtctatggagagcctttcccgaaaatagtcaaatgattctggtcctcgacttatttccccagccctatctattatttttacacctcaactaaatctcggatggtggaagtgcccacagtattttcccaaaccggctcgcagtggatattgggaattatctaccggggcaatgattaactgttcttgtgtgttagtaaatttcccatcaacctgctactttgtagcccgttcaggaagtctcagaaatggccgtcgcaatgtccatcatggtatccggagactcgggatgttgcatgtgtggtcgagatgatggaaggagtgacactgcaggtgaaaagggcccagagaggaagacacctgcaagcgctgcctaagcaggaaggaagaaaagtaactaaattagcattctacctccgctcatctccaatactatatcgtgataggatagtccctactagaatcacaccagcatcagacaacgatcgatgttcatattccaagccagggagacagtcgtatagtctaattctcgggaaataggagactatatgaagtcaagccttgaaggttgatgcagtctttcatttctacaattggtaaggtaggtatctagctcaattgctgttctcagttaggaattcaaaattatttcaattggatataccaaaaacaatcgtcttatcataggtgattaaatctatacaataatccgccgctccttgagatactcgtagtccggcatggactccaaaacagcctcgtgcaaaagctgcgcagcttcatccccaagctccgccttccacttctccatttccacagcaatatcaataggacccgtcggcgtcttatccttgacaatccccgacgacgcatcaactgtagagcgcatgacacagttgatcttgatctgcatctcatagtgctcattttcagtgtcatgcatacccggaccagtccccttgaccgtctcctcactccactcgtactgcatcttctcaggatctaatcccgtgagctcacaaaagcgcttcaccgcggccggattatgagtaacatcatccgcatccaccagaacaggctgagtaccctgttccaaacaccaatcatacaccatgcgggtccaccgcagcgtcgtgttcgtcttccacacccccatgaactccttaccgcccatgcctccgaatcccttgatcttggtcatggcgcgatacatcgacgcccatgctaatgccgggtgacggatgataaatgccacttgccagctgcggaggtattcatccggcagaacagtcttgttcgagggcgagaagctctgtgggtcgtagctctcagataagcgcagctgaaacgttttgaagagctccgggtctttatttcccgtcatcatttcatacatgagtgccgggttcatgaaccagtatgcgtgttccttgatgaacatggctttgtcctctttctgcgcccgttcggagtactcctccagacttgagacacaaccatggaatgatgcctttatttcttccttttgggtgcttgtccactcgttcagtggcttgtcggcatacccgccgtggatggcgggcgcaaaggctgggaagaagaagtagcctccttgttcgttggttaagaacttgggctggttgtggatgtccacgatcttcagaagaagatgggatgctgagcgcgggacgctaatgaggaaaacccgccggggaagtgtagtggcagtcattgtgagggtaatcattggggacgggtgctaatgaagctcaattgatggtttttttcggacttgatggtgtcattcattcgagactgggtccattgaggcttaaatagtttctctcagagccgtatcctacgattttcttttcagggacttcgtctggagccgcatgcatccctgacattggggaacctacctgtcattgtcttttcgcccccaagaccaatattgcggtactatagaagcgatcccatactaactcagccacatacaaactaaactctgcttactggatacaaagcatctgtgtttaaccgatatgtccaatcaagatttgtccgtaagcactaacgaagcgaacggtcattaccgtctgacctggcataaccccaacattactttaataaagaagttcagccgtactagtctccactcagctgtctagatactagctggataagagaggacccggttagcccccttccgaagccattggagatatcgttgtgttggcagcgttacattcttcccagctctagctcattgtcaggattcagttaatctttgtacattgagttgttcagccagccacaatattgccgggtacacaactagttggttggttggttggaacttcttccagccttgtagcactgctttgcactgcctttgcagcggtagaatagcccctacatctctatgtttgctcgttaagtaggaagatggtactctttagttttatggataaagccaaatgcatgaagcacatcaagtattccatacaagcttgttaatattcaatcacaatatatgaaccccccatgctatttcccaatgcgccatatctgaaacccacgactagtcatacaagctgctataccatacccaagatatcactgtatcattaccatgcacctgcatcattatcaaaccgagacagttctttttgcgcatcctccacgtccttctttgccttcatgcgcatatagaaaatagggcaatccctggacgagcagatgacttcacagtgcaaactgccctgacaacgctgacattgggtccagagtcgtccaaaccggacttccaggtctgatactttggtcaatgacttggtgtagagctcgccgaggcgaggacggcagtaagcgcacactgcgccctccgcttcttctttgccggataaaggcttcttgcatccaaggcaggtttgcgtcttcttagcgaacttcatcagtccgcccatggttggcgcagccacagagatggcacgggtatgttcgcctgtgaggagctgactggctttcttttctccgagaatgggctcgaaaatacgacctagcggattggctagttggttgtcgagatagtatttcgtgtcgatggggatgttgttctcaagaacgtaaattggatcttcagacctttcatagttctttgacccgccagcacctttgataatgacataggccacacggtcgccaagcgttggtgctgaacctgcatcacgctttctcatgcgctcagcgagctccacgtgtgcctgcttggcggtatacgcatccttggacaaggccttggtgatcacgagtttggacatatcgatcttattttgcaggaggtcggaaatggtgtccttcacgtagctgcaatacagttagtaacaagccaagggagtattcgcaagtgatcttactcttgtgccccatcaatgtctcgctcaaccagaatcttttgtaggaccgtctcgataacattctgaaccagcaggcagttgtctcgacgaactgtttcgatacccttcgtatccatcttgtcgtacttgttggggttcgtccagtataatccggcgtaccgcttcttgttgattaggagatatgggaaatagaccttttcgaactccagtttgatcggcttcaggaacttggacgagacatattcagaggcctcttgtcctagcttcatagcttcctccaagttgtcaacgccaaacttaaccatgaccgaatcagtatcaccatagatgaccttggcatcatgagaataaccattcgcgattgtgtaccgggcttccacctcctgtttggtcttctcgatcatctgtcgtccataactggttgtactactcgcgatgggcaagcagggcagctttccaacagttgcacctgtgagaccgtaaacactgttggcgctgatcttcagagcgagctgtcgtccgttcagaacagccttcttgaatgggtctgtctcaacggccagctctttcttagcacgtttacgtgcagacagcagttcttccaaaatctgtgacaacaggcctttgcgaactttggcggtacagaacatgtcaccgttaggtgtcacgatgtagtcctcatcttttacaagcttcagcctttcaacgctactcttattcaagagcgttgtgtagcagagattatgggcttgaatgatggacgggtatagggatgcgaaatcgagggttgcgataggcacaccgtagtagcccctgacaggctcgatgacagtagcaccttcgtagtcttgttcgtcgttggatttcgtattcgggatgacgagctgctgttccaaagccttgcggaaaagctgactgatgaacttgacttgctgacctcgtgacagcaaaaagttgaagggcacacccgtcactctcgccatttcggtgtagttgaccaggcacatcaacttgtccatcagcctttgcggcagatacgcatccttcaagcagtagacagctaaacgccgtcttgaatcgggagttccattatacagctcagtgatcatagtgtgatggacatcctccttctgttcgcccaagaattcataagacaccgagttcaaggtataacttcgcaagtggtagtctcgctgtactagttgaagcatatcgagctggatgcgaccattagtgttcgttgacttcgtgtcacggttacccatctgcttgctggagaagttggtttccttgctctgcgactgcacgccgttcaatctggtccagtaggggaagccagtgcatttcagatgcttggcacgatccaacagatacggaaaatcgaaattggcaatgttgtagccgatgatcacatccgggtccaccttttgcacgaaatcgcgccaggccataagcattttcccctcgtctttgaattcgaggatctgagtgttgacgatcaaactgcatgtgtctaaaacaaacacattacgaataaacggtttagactctccgtagcgcgtcacgacattggcgatctgaatgactgggtcttgattcggttcagggaagatacccttccgtccagcgcactcaatatcaaaagacaaaatgcgcaacggggccatcttggcccactcgccgttgggtggatgagagataagatctcggtagtcgacactagcctcgatctgacaattcgacaccttctcatgttgctggaataagcggtatttccccgcctttgcttcaacccaagacatgcccgaaatatccgtgtcgatcatgaatctgaggaggtattggatgctgtcgaatgtgagaatcccgccatcagagttgttccagagacctttatagttcaagctttgggccccgccttgttccaacgctgaccggactttgctgatgaatttgggatccgtaactgtgatcttgaggtaatagcttttctggttgccttgaaatccgtagatgttctctcgcatcgttatttgcactgactggatcgtaggttgaaactgtccgactctgctctccaggaaagctcggtagggctcgcagtcgtctttggtgaagttcactggcgcagcgatgtagagatagtgttggaacccggtaacgtggaggaggaccgattgaccggcctagacgcggacattagagcatgatcggatgccaaaagagtacgcagagcctacctcagtgacaccaaacagtcgaacggcagtcttgccgcccatgattgtcccctcttcagcatcgatctgttggaaacagatattctccgtggacgggtcaaattcacccagtggcggtcgctcccattgctgatctttttccgaattgctgtccttcaacccgttgatgtcctgggtcagtttctccagaacctcctcctcgaattgactcttctggggctggctggagcccggaactcggcgctggccatttgtcggcggtttcatagcggcagcagggccattctctatcctgcgcttcttgagcgcactgggatctgttacgacaccacgagggttatttgatgcatcgcccagaacccgcttctggggcatggcgacggcttcaggcatgatgaagggtcatagaaatttaagcaggcgcgtttcttttctccaataattagggtatcgggattaatatgagaaaaagaagcaggtttgacgattggtagtattgtcacgaggaatgatggtcgtcgcgggaaactgcgctcccccggtgttgctgcaagttcgtgtctcgttcgcgccggacgtgacgccttcacgcgttgagtgtctcacgtgatggaccgccgcgtatcgacggcgagacttcagacgatccactgctgcgtgggggccctgggcaccgattgttattgtttctcaaataatcagctagcggacagtgattcgaaaacttattcaagaagttctcttttgttctagccatcctctgctccgtccagcggactttttcgccccctctcttcgtgtcactcagcagatgacgtcatgcagcttgcgaaacaatctgtctattgaatatgccatagattaagtactgatatacgatcttttggtagactggaattcagacatagaggcctgactgtcaggctggcatatgttgctttttgctgtaggggtatcggcagaaaaaccagcactagtagtacttttggtggcatctattgatgtccaatttatatatatcgctccaccctgaaatcaggttcaactttgactggttatcaatggttaatactggtatacagtagtaaatactagacgggagaaaaaagaaagaaacgaaaagaacttaagaaaaggatattgctaactgtaattcaaagtaccaggtctttgacttcatcattttacccattcaaagtaccccttggagataatgttggtagccatgctcttgacgacattactagacaaacaatgtaagcggaaaaggctcgccagccatatcacggccagacatagagatttaacagaatcgttcttggaacaagtgccttactgatgtctacacaaacgaattcaatcaggaaaatgatggtagatacgaatacgtaagctacaagactcggattgcagcctgcttatcataccactctatgtcagcctacgattgctacataggttatattgcctgctacagaggtatggagcgagatagacccatgtggaaggattgatagattgactaaataggataaataagacactagctagggaatatctggctagagcctgatcatgtacaaagaagatgaatgttcggaaatgtacacaaatgttgtctcacagaccgttgaaaatgggaattatctcagcttgcttcattgtcagcttggcagcgcagaagcgaacccacaaattccctttagtagccacggccgtgtccctggtggtggtgcttgttcgaagcctggacaggagcaccaagaccctggggggccgaggggctatcagagggagctccagtgggagcagggccgttggtgactgtcctccaagaccaggagggctgggtggggacagcggaagcgccggggccagcctcagagtaggccgggacaaaaggagcatcgtcagagtcggcacgcttggcgacagcggaggtggcggccgcgccgacggtgctggaggagccagatccgttgccgagcttaccaataccggcgttggccttgacgtaggaagcaactttgctagcagccatgacggtgacgtcggactcaccagagggccagctgctgatcacagagctgtcactaccggagagagtaccggagctgatcaaagtgttggggacacaggtgcgtccgagggtgctggtgcaggtggaaacatcgctggtgttcacggcgaatacggcaccggggttgctgtcggccaagagaggagtgtcgacctggaccatcacattaccctcgatcagagcacgggtgttcttgccaacatcgaaggcatggccagtgttgttgtaccagtagttgttgtacgcgtgccagaagctgttgaactcaagcttgggggaacggcccgaagtgtggtggatgtagttgttggcgaaggtgatcttgtcattgtggccgtatccgagactagatagtgttaggatgttgtaatgaaggaggagcgcgtgggacgacatggaacttacacagtccagtagtggtggccgtcgcaagtcgcagaccagctggtctcaccatcaaactcgctgttcgaaatggtaacgctgtgacctgcgcactgtcagttttgaatccaaacaatgtacatctatttttggaaacatactggcttcgtatccggcaacgaacatctgacgaccaatgaggttgatcttgacgtggtcaatccagacgttgttggtgccgtcgagggtgatagcgtcaccaccccagatgaactcggggttgagctccgtgatgtggatgttctggataatgatgttgctgacaccgttcaccaggcgcagaccctttccacgcaggacaccagagctacccacgccaacaatagacttgttggaggcgacttccaggccctcaataccggcgttgtcgtacgtgcaggtcagggtgggatagctaccgcaccagtcggagccattctgcttgacggcattctggccagagctaccgcaggtgttcgaggcgggtttgcagcactcgcagttggtgcacttgccctcgctgccaaggaagttgaactccttgtcgataaggatgacacggggggtgctgtcagacaaccaggtcttcagctggctgatgtcgctgggcgcagcgggagtggcatcaccgccaccggtcgtgccgctagcgaaaccgaagggggagccagtgacaccctgcgctgcttggactgaagctccgagcaaggcagttgccgttaagagatgacgaaggagggtcattgcaacgagcctcagaaatcaaggttggggatatgaaaggaaggactgaaccagcagttctgaagaaaacgaatgaaaagaacgtgaatgtgtgagttagcttggtgatggaaactgaaccaaagctgagtcgagaggtagtttaatagttgaagactcgaagaacctgccatagagggtttgggcctatctgccatatgtgcacgggaagttgacgcgaacatggaaacagccatgtcaatcatggcggagcctgtcgcagattgatcatggatcgcatggtgaaactctcggacgggaaaaatccgcggtcatcttctggttgcttttcacccgcccgccgatcgtgcaacggtttgagcccttgtcccgcgagtcaagtctgttaagtctgacccggcactttatgacccgcgcacagtctccagctcgtctgagacactgacgatctccaattccatgcgtcacagagggaatcatgattggcacgctgggtggcggatgagaagataacctagtgatcgtcaggatgggaggatccactgtgccaggactcattccccacacttaattgaccccagcagatcgtcatgaactcctattcaagcttatccagtttactactggctcaatgccccccccaagacgcagttctatatctttaatgtgtcgcgtgctgcggggagtaaagtgcgcttcgcttcttcctgcatcggccagattaaccaacgcgggatgacgagtaccatatccacattccggttctcgaccctgcttaatggagatagtgcttgaaacagtgatcaatcataccatactgtgaagcaaaccggcttctggaatcaaacggcacaaccggctctaagaggcgacataagcttgtcggtcgaaaagtgatattaacctctgctccacagagagcgagactaggtggcctccgtccactcttcatatccaacccacatttcaaattaactcatggaagttgatagcgcgaggacatagattgtggtactattgtgcaatggcattggtgggaggccgccttgggcactccggaaaaattcagccgtgtctcactctcactcaacaaatttgccgctgctacttgatgcagtgataagtgggtattttggagctcaagacctgctcaaagaaaaagcagaggcaaaggagccaataatctaggcccggtctatacgaacgaaagcatttgccttgggaccaacaccctgatgatcaggcaatttatttgttgacggatttatgtgatgcaatggtcgttctttgctggacttgcaatcaatggacatatgccttattgtcctccttttcattggtgggaaattccaagaaaaagctactattgcagcactgggtcagttgaattgatccatacaatgaagatagaccctttgcgtattgctgaaaggtgtgagtgcgggacaaaaggatacctgtgggcaactgaatgggcgagaagaccgaatggttcgtccaaaggcacaggaagtactcaggtgacactggtttgaagagctgaaatctgatgaagctcagagcaagtccttcgacgtcgtaggtatccaaggttttgtgcgttcgaacctactaatggcgtcactagcttcccagccccgtccctgtgcgcttacaggaaatgtcattgtcgtgactatttgcgatggctccggcacaataaggagagtgctaaccatctaacactcttcctggacaatttatgtggcctcataaggcagccgccttggtaagttgatccgagtcgtttgcatcttgagcaggtgtatttgtacaacgtattagaaaattcacagcagaaagctgcaaaggatagagaggccttattgctgtcagctccaaccttaggttaaaggtgtgccacatgcaagggtctgccaccacggtcagaacatagtgcagggctagggaccctgtggttaggccaagatcttctgaccatcccccaaggtaccctgttatccagttatgatttaatgacgatttccccacgcatgaagtagaagacaatatgacattcagacatcatgccatcgtttgatcccacaaatgtaaacttagacactgccagcgtggaggacatatactgttacctgcagttgtctggtaatgattacaatggacacctgggtgcacgcatctctgcgatatttgtgatcctgataacatcatcagcatgtacgctttttccagtggtagccaagcgaataccacgctggaatatcccataccctgtctatctcttcgctcgatacttcggtacgggtgttattgtcgcaaccgcattcatccacctattggatccagcgtatggaagcatcggcagcacaacctgcgtgggcgtatcggagcattgggcagattattcctggtgtcctgccattgttctcgtgtctgtgctcatggtgttcctgatggacgtggcttccgaagtatacgtcgagcgcgtatatggggtggaaaaagagcacgacgcgaccgaccggtttctggcccaagcaaacttaatccagagcgacgacgagagtacagtcaatgacgatgctgctggaatcaagcagcctggaattcaagatgacatttgctcagtcgaatccgagcgctcattccgcaaagatatcgctgcctttcttattctggagttcggcattatcttccattcggtaattatcggacttaacctgggagtgactggcgacgagttcacgactctgtaccccgtgttggtcttccatcaagcatttgaaggtcttggaataggcgcccgaatgtctgcgcttcgctttggccgacattggtggctgccgtgggttctctgcatggcatacggcctcactacgccaatttcgattgctatcggcataggggtacgcacaacgtataactcgggatctaggacagcaaacattgtccagggcgtattggatgctgtctcagccggcattctgatctacagtggattagtggaattgctggctcgcgactttctgttcgacccagaccgggctaagcggcggtcgcatctgctgggaatgatcttctgcgtattgctgggagccggcatcatggcacttattgggaagtgggcatgagaatgaagataactgatgattaggagaggagaaagcgaataatggtggtagtggttgaggggaagagagccgggggagccaggaagacggactgtatacgtaaattactgcgtaatattagtgtgacaatgttacgagagttccactcccgtctggtttttgcatttcccgcatcactttttgcgataggcccccaaatcgtcaatcctgtccgtcctgagcggtggctttgcctgcatgaacagaggcagcagccctgcgcggtcggtttaaagggctcagtcctctccgtcatcatcaccgctcttcatccacaccctttcatcatgctagttgggctgatcatggagaactcctgcttagcctcattatttactctaccctgaacaaaaacaacattacttcaaactatccttgcactcaaactacgactaccaacaccgtcgctttctgcttcttgccgctatgggtaagccaaagctgacgccggaacccttcgaccttgtcgaacttctacaacaaacctacgatgactcgcgcattatcgtcttcgtttgcctcatatcttggatcgttggccgtctcgacctcggtttaacctggttgtttttcgtccttgcagtgtgtcggacttatgcagtggttaatctaacccgagtccagcgtatcgtccgcgatgaatgcaggcgataccacgcacataaaatcctctctcgcggggagactgtggaatgggtaaacggtgttctgcaacgtttttggcacatgtaccagactcagatttgcgatcatattgtccgctacgtgaataacgggctggcacgacgagccatcactgagaatggaacaaccccgcagaaagtagtgattcaatctttggctttaatcgaccttccgcttcggtttacgcgggttcttgtgcaccagaaaccttcctcgccgaacctgatcgttgagggacagtttcaggtaaacctggcaccgcatcccacccatcatcaccttatcgaaagttccggacaccctcttatcgatcttacgattgtccatgataaaagttcaggggattctcaccatcggaatcatgatttggcggtgcaggtgcggcagttcaagagtacgggatccctgaaaatggagctagacctggagggtgaccatcccgctctgctacagccccaggttgaccttcaggagcacccaaacatggactgcaccatcaagtcgatcagccaacatcactttccgcttcattttgcgcatcatgtggactggaggcgggtggtggaactgcagttgcgggaggggttgggttgggcattccaccgaccgctagcgctgcctttcacactgggagagcggtggctattccgggtaatgacgtggtggtggcatgctgtgaactagttgcatccgcccaagatttgggcgcaggatgagacgcaataattgtgcaggtcataaatagagtcgtctagtgaagggtccctgattgggtcgcttgctcccccgggcgggtggattttctccgtagggctgagctgggcggccaatccgaaaccgccaaatggtgttgccttgtgtattgcaaataccgcaataccgtctcttgtcacactcgggcaatgccatcccttacttcctccatcgaaggggttcctcctccaaagaagtttcgagccagccccctcagccactcatgcaatcattggatatcttctgttatttttggcgatggtacagttgacttccatgggttggtctggtctgtcaccctctgcttggctgggtaaatcctcctccgccctttgtccctgaaccagacgctcaggttctccgggccagcaacggtgggtggggctgggatgatttctactgcgcaaccgtgcgcgtgaaacaatccgatcaagtcctcagcggcatgaccgttaaagagaccacctatattacacaaggtgcatatattgcatctttgtggaacaagacatccagtactactttgtgcttaccagttgtacccagcagacgactgcgtaatctctcgacacctccagattacgccatctgttatgcaggacaagttagaatgcgataagctactagacttctgccttggtggtatttcatcagtttgatcatgtgcaatggtttggacatacttcgatattcttgataagcgatagctttctaattagcgtacaatgccgttttgccgcgtgccttgtgcttcatactagacttaaccgggccggtcaggtgatgatgacggtatccttgtcgttgcgcttatatactcgacttcgcctcttttgctctttccatccttccgatctttgcgagacgtcagtagccttgacatcatcaatatcaccgatcgttgcgttgcctatggctaatgatttctcatgtccttctctaacattttggcaggttgtttacaaccggatagctttattattagcatgaatttctctggtgcaagtttagtattggacctgacctagactcgatggctatcaagaagatgaatgaggatctgaaagcgcatccccgcagatgtagcacgttctcggactcttgccggatcgccgatggcctgtgaaccttgcttgcaagtttgtttagatccaaaaaggtcgatcttcaatggctcagacacatcagtcagatcactcatgcactccgactaatactcaactttaacaacggtgtttggcaactcggtgtcactccatcgaggccccggaacgcggtggcggggtttgttgggggcggaaacttgcacctctctcgttgctccttgtagcggcccagcgagtgacccgctaaagcatccgacggctggccagtttggtgcacctcccatgcggcgtcattggcccaatgtctcagccaaacgctactagtcgcgtctttcctcgcattagcgtggcggctccctcattacaaatatgccacaccataacttagcacgttttgcatccactcgagtatttcgttcacaatgcctggagagctgatcgtgcaaagtgaaagtagacaccgacgcaggaagcctgggaagagatccaaaacgggatgtcgaacctgccggttagtttgatgagtcgctccttggattgtccatgtctgatcacgagttcagggtacggcgcgtaaaatgcgacgaggcaccggggtcttgtaagaattgtacttctacgggccgagtgtgcgacggatacgatatgcaccgatttcccatcaagcgagcattatgtcttccaaccctaggaccaaggtctgaaggtatcatgacatcagatgagaagcggggattttcttactttcaacaccgcctggttcctgaccttgttggatttttcgactcctggctctggcagaagctggtcttgcagatgtgccatgcagatccagcggtatgccatgctgtcaacatggtaagcgccatccatcaagatgccgaggaaagaggcatgcgactggcaggagaggatttgcagaatccaaaacatcggttcgcacttgagcaggccgcccgatctttttcacatttgcagaaacgcagggcctctcccgacccacagttgcgcgaggtcgtgctggtgtgctgcttgctttttgttatggcagagctattgttgggagaatttgccagagcctttatacacctacgtagtggcacgcaaatcctagaggagtcgctgcgccttgggatacccgtgattccttgtctgtctgagactctccgcatcttgaagtcccagtcgtcgcatgtcggagacttcgagtcagaccctagcattcaaagcgaaaaggacaatgattttgttatcgaatcgttggaggactttgataatctgaaagaggcgcgtcgaggctatcagagaattatgtatagcgtgattccattcattgctacggcttggaggctttcagaaacagaaatattggcgaattacgaaaccctatggaggaagcgacagaagcttctattcttgctggaatcccttgcagagcggttcgagtcgttttaccaacaaaagtatttcagtcttagcacgaaagagcaaaccggagcggatatcgtgcggcttcaattggttgcgaagacgatcgtactgaaaacgtgtctgcttgacgagtatgatgacagactgctcacacttgaatacggtaacctgttatcggaatacgaagaatttatggacaaattcccctgccgtcctactattacactcgactacggactgagctttgggctattcgcggtggcctcgaagtgcccagacatgggcatccggcttcgagctgttgatgccttgcgcaggtggccgcattacgagggcatgattaattccaacgccggagcgggaatagcggtggaggcgatcaagttggatcaacacaagatgcagcaggaagatgcggtgcgagtatcttcaatggatcaggaacctgatgtaagcttttgggaaatgatcagaagcacgcagaatgggacgcagtggccggctgtacgcgatgtcgagctgcggacgaaggagactagacggttgtgaaaatggcaggagtgcgctacacgtcgtgactaatatatttctctttgatagtatagtctagctacatatactcgtggcatccatcgtctagttaacaaatggcaaccaccaagtagaagatcaaaccttccctcaccaagttagaccaccttcttgataaacgcctcgacctgctggtccactaattgaggaccgatgtaatattccaccttggtgccattcttataaccaacggtagccggaatagcagtgtacccccattcctcagccagctcgggatggtcatcggtgctaacccaggccatgtacacggtagggtatttggcaccaatgctagtattcttgagttagtatcaagcaatgaaagaggcgaaacgaggtaaacgcatcatcgttcgaaacatcacatcacagagtagggaattcaggctggctgctttacctctcaaacttttccttggttacattgccgacgtcactccacacggccgtgaacatcaggatgaaggacgcatgatttgcgatggcgtcgttgatttcttgcttgctggacgggatgtcaaaattctcctctgcatctgggtgttgctcttcggaaaagagttccagggtgtatggggcttgggggagggggagggggaggggagtgtttacctgttgagctggtccatggttcaagaagcgatgagttcttcttttattgcctctttagcgagaaagatctgtcagaggatttgacttggagagaaaagtgtagtaggtgtctagtgtgtgtttgtttacagaaaaagagggagagggagtggccctatttatgttggaggattcaggcttcctcgccacccagattccactgatataccctacgtgatcagaagaaaatgtaagctgaagacccagctgaccagcgcggcgattaaacgatgcaatcacgaaatacgatagagtaacgggcattcagtgtgtgcaaggttcggcgtcttggggatcgtggcttggggtttcccagccagtggcgagactggagttccaattagcaaatggatcagtgtctatcacttactagaattcgtcatctcatcggaatgatcttaattgcttcttcggagatgatgtagaatctcatctagcaggactcagcgatgacacatgagatgcagccaattggctgactggaggtggggggacccttgctgtctttcctcaattatgagtgagaagtgatgctattcaggaagaacctgctaccttggatgggtgcaatttcacacggctgagcgcagccgaaatgagctgctgcaggaccctgatcaccatagcttcattcattcgcttgtcgaagagggggtgttcttggcatgcataaaatggttacatctccaggtgcatctccacctcagctgaagtccgagctgaacagctaggcgaagctaccttaatgcaggctaattagatggcggcgttgggtcctgacccaagtggccagttgctattgaccagtcagatcccagggaaccctgttccatcttcatccctcaatctatactcaacccattcgacttcttggtatacgagcaatggttacatctacaggaaacccgcgtcgcgcaaggattcagaactccaaagtcgttgtcgtcaatatctgtatgtgcgccgttttagcaatacgaaatgagggggaaattcgcctccgtgagagataaataagggtcgacggaccatggaattaacctctccatcagcaacaacaacaacaatctcagaacaccaatatcaattcatctcgagtctgaactcagacaacacaaattcttcaaaattgaggatttagtcttgatcatggcccagtcagccattaatattgaggattcgaatcccccaagcctccacatcatcaagcagtggaaggcggtcaaagaaagcctgcccttcgatgaccagcaagactatgtgaacgctaaacggggctggagaggtcatctcaatcccaaccaggtcaccaatgatcaaggcgtggtatgggacaacgttgcctacgattttctgaaggaggacgctccattctcagccaatccaagtctgtggcgccagtcgcagcttacccgcatgaatggactgtatcatgtcgccgggcccatctaccaagtgcgtggactcgacctctcgaacacgaccatcattgagggcgacgagggtatcattgtcatcgatcccctcacttcgctggagaccggtgctgctgcactcgccctttatcaggaacaccgtggcagcaacagagatgtaaaggctgtcatttacacgcactcccacgttgaccactttggcggggtcaaaggcttcgtcagcgaaaaggatgtcgaggaaaagaacgtcaagatcattgcccccgagggcttcctggagcacgcgatctccgagaacgtctacactggcacttcaatgagccgccgcgccgcgtacatgtacggtgctgccctcgagcagggaccgagaggccagatcggcgctggactaggacagactacacccaccggcaccgtcaccctcatcgcacccaacatgatcatcaaacgcaccggcgaaaagagaaccatcgatggcattgagatggagttccagatggcaccggacaccgaggcgccttccgaaatgctcatctggtttcccgatctcaacgcactctgtgctgccgaggatgccactcataccttccacaacatcttgaccctgcgtggagctgtggtccgcgacccgcactcttgggccaaatacctgacagagaccattgaccgatacggcagccaagccgaagtggtctttgctcagcaccactggccgacctggggcaacgataacatcctgaagttcctcacctaccagcgtgatctgtacgcatatgtacacgaccaaacccttcgcctcctgaacaagggatacaacggccccgagatcgccgaaatgctcaccttgcccccggcactcgatcaatcctggtattgccgcggctactacggctctctgagccacaacgtcaaggccatttaccagcgttacgtcggctggttcgacggcaacccagcccacctgtgggaacacatccccgtggacaaggccaagaaatatgtggccctcatcggcgaggacgagatcatccaagagggtaccaaggcatatttaggaggagactaccgctgggcagctgagcttctgagtcacgctgtcttcagcaacccgcaccacaaggatgcctgcaaaagactggccgacgtgtacgagcagctcggatacggagctgaaaacggcacctggaggaacttttacatctccggagcgaccgagctgcgcaatggtaactttggcacgcctacacagacagcttcggccgatgtggtcggtcagctcaccccggatatggtccttgatactcttgctatccagatcaatgggcccgaggcgtgggataagaaggtgcttatggatcttgttgtttcggatcaagataataaaacttaccattcttggctgtctaatggggcgcttgtctacagcaccgcagaccagtcagacgctgctcaggtcactctgacgggtacggctaagcagttgactgcgctggctgtgtatggacctgatcctgatgctttggcaaatgccggtattgtaatctatggggatactactgcgctggatacgcttgcgtcgttgctggatccaggtgatcctaacttcaatattgttaagccttaggttgtgtgactagcttacagtggactgggtcaggaataccatcccgtcattgtcagagtagtttcagtcaactaagttcttagttttctggatttataaagtgcttagaataagccaattttattagtattgtctaggatcgattatgtccaagaaaatagatatggtgaaaatgtcgagttcatattgggcataacacataatcttaagaatggtcgcaaatactcttcattcctgccatctgtgaccattttcgattagtatactatattgttaccttttcgatctaattttatcccctgttgtatttgaagtctccgcgaatgttaccttcaatgacgacacactggtagaacggaattagtagcatgaatatttcccctttgagatagagaaaagcccagcacgaaatatgtcccgcaaagcataattatgcccccttgagctactagtcgactcatgaccttcatggtgacttctctttcctaatattactaaccagcagatagtgaggaagttagtgagcactattgtgtaagctccggctaacacatcttgtctatacaggctctataaccatcccaaaagcccgttgaacatatgtaatggtagtcctatatatagaaggaacgagtgaaattgccaccaatttatcgtcctagtatagaattatttaggtacaggataccgcaccctccacgaatactgtcttaacatcctaacgcccttccaatcccagcgttcacgcgcacagagctcagcgcactggaagagccattcgaccgctctccacggctcacgccgggcctccatctcctgacaaatcatctcatcgagatcagagcttctaccaaagcagacgaccctagtggatgtataaggattgtaccgctgggaaaggctgcgcggtggcaggagatgggcgccacgattgagcagcatgcgcatacggacgcggccggtgtggctatccatatgcctattgtaatgaatggccacgtgtgacagtggcgtctcgtagccaatgggttcgttaatgagctcgtttatgtccaggccgtgttgaagcaagagatcgattgttttggcggcatctgcatctgatgcagctgtacaggctgcttcagcgagcaagttgacagtgggcgacgactgggctaccggaaagcctcggtccagcagccactgaagtgtctcaatctttcccgtagaggccgcgataccgagagcctgctcgcacgcggttttgtccaagtgctctgggaagatgtagttattccatttccccgtccggacgagcagatcgagaaccgccggccccccgcgaatggcttggtgaaggagattggcccgactcatatggcgcgacagatcgagtccctgatcgatcagcatctggactattgctgtacgacctgacgccagaacgatggcgggtagtgtatcacccgggcgatttatggcggtaggatcagcccccgcggcgagcaagcgacggaatatgccctcgaatgggatggcatgccttaatgccgcataaccgtcctgcgcatcctgatcattggggtctgccccggcgctaagtaacatggagaccatggcttccgagccctggataatggcctcaattaagggcttccgcatacgcatccgtcccggcgatggagatgcctcggcaccgtgagcgaggagcacctggacgacctcggcgtgacctcggactacagcccagcaaatggcagtcgggagatcatccaggatgaacgattgaccatatcgagcatttgggtcgtacccatggcactcaagtagctgccgaaccagagccgtattcccgcgcgccgcggctacgcacagcagcgcagccttgtctgcgggctcaacggtgctagtcaggtaatcccatcgttcaaagaggatatcaactacgttgtcgcatttccattgtgcgcttgacgtgaggggacacatcgcagcattatgggacgatggcaattctgagccttggcagcggtttaactgatccatcacgcccgcatcgagcagacaccggacacactcgaagtgacccagacgcgctgcacagcacaaggcggagcatccgtccggtaccgtggggatggtgggatcggctccccgttggagcaggaactgcatgacctcaaggtggcccccgcgcgcagaaagcatgaggggagtcatttgttggtgatctcgggcgtggatgtctgctccagcgtcgaccaatagctgcacaatggctagatggccttcttcggcagcctctataaggggtgttcgtccgtccgaatcggcagggtaatcgacatgaaacggccgcggcaggtgatccatgaagaagcggaccagggcttcatgaccccgtacggcggccagcaacagcaggcttccagggcccctgtcatagtcctcatggcgcggattgagccagccacgggtgtgacggatgtcgactcctccctgctcatacagataccggacaatggcttcatcgccctctaaaaccgccaacggcatgggtcgccagagagtatctggatcacactcattcaccgacgcaccggccttcagagacttctgcacagttgcgaggcatctgtgcttaattccccatgataacgcagagccgttgttatgttgtacattatgtcgatacagcatgggattcacgacgcggtagaaggttccatcagtctgagcgagggcattgatatcacttgcatattcaaggtggcccacaatctgttcgatgagctcgactggaaggagaatagccgtcataatgttgttgaatggaccatgatggggatatcggagtgcgtgtagctgaaggagtccaagtacaggtattcctacaccttagtatagggttagtcttttggtgattcaggacgcggcagaattttagggaactccggttgtattgggaagggatccactcgctagtggggccagatccatgccaataaattcctcgggtaattcctactaaaagggcaaagaagattggaaggtactgagtagtattgttgagatagtgtcatgggaggatgtgtggaaaggactatctaatggtcttgcaaatcctttcgtgtataaacatatcggcacacttcatcataaccaggctaacaatctggcccaaccattataacgctacatcacagtttattgaatgcatagataggactcatgcgggtacatggtcttacagtgtgaaattctgctgtgatcatcagatctagaagctatctttatcttctcctccccgataagacatcccgtgcggggtgataagacgacccctcttgagatagaaatcctgctgttcactcaacatgaagagacagacacattctgataattcattatcatctaaatataagtcactgccatattttagtgagaatataatgtcggccagcaactcagagcctggggaatttgatcagatccccgttatcgacctctcggcattgaggagccctgtgctgaaggagcgccaacggctggcaaagaagatcttcactgcctgtactcaggtcggattcttctacatcaaggtataattctttctcaataacctggcgaaggaaggtagctgactgttacatagaaccatgagatagctgaagatctcatcgcttctctccatgacatggcgcgtcagttctttaccctctcgcagaagcaaaagatggattattatattggaaggtctagggtttgaatatacgttctatcgacaaacgacagattactgatacgaaagtagaaattccgcggtttcatgcctctttactcagagcagcccactgacaccgatctcggggccgctcccaaggcagaccctacctcacccggggcattttccgaatccttcgatatcggatatgaagtcgctgcagaccctcttaaaagccaacatggcgatggtcctctggacacgtacgatctgtacggagataatcaatggcctgaggaagatgtcctccctggctttcgcgaagtctatcttcggtactttgctgaggcgctgaccttatctcgggcgctgatacgaatctttgcgctagcactggatctacccgaggacttcttcgacacgatgatcaagaaccccggggccacgtcgaggatgttgcactatccaccgcagccggttgcggacgaggtgagagtcggacttggagaacacacggtaagcaggtatcttaaagacaaaagaaatgtgcatgctgaaatgagaaatacctatttctaggactatgagtgcttcactattctgtcacaagatcaagttccggctctgcaggtcctcaacgctcggcaggaatggattctggcaccgccgattccgggcacgttggttgtgaacatttcggattgcctgtccatctggtatgaagtgctttctttcgtaagtttcgatttctacaacgtaataacaatgtgtacaggacaaacaaaaagttcaaatcgacaatccatcgtgtgacaaacctgactggacaggagcgatataccgtccccttcttctttggtgtggactatgacaccactgtggcggtgctaccgagctgcattaccgaggacaaccctgcgtgtaagaagccgttcaaagcgggggaggtaagacgaattgcatgcttcaagttcttccttctcaaggaacaggctaattctggtacgtcatagtgggtgcgccaccaattgactacggcctatgttggatacgagccagagccgccgacccaagggaattagaaccattgcgctgggaccaagaggggttgtagaagatgcatcgtgcagatccctggacttggaattcaatgggacatagataaatggctaaatataattcccccgtgcagtttcgcggggccagcttcgaatggctgtgcagcatttcggactattagtatttcttctgattgagtggataattacactctcaaagaatgttacttttggtcatcaataggcaacattgcatgggggtttcagcccaacctctatcgtattctcacaatgtgacaataaatcattaagaatgtcattgggtagaataaagacctcaaatttgggcggttgctcagcctcaacgcgatagtcgacgatggtgatcaatagagaaaaagcaaatacacaaagccaaagcaatatccgcaatcttgcatctgaattgggcgatcgtgtagacaggctacgataagggagcatctgtgcttttaggctacccctggattagagattcacttggttgccgtatctcgcggcattgacctcggcaggaagccttgagttaagccatacaacacggtttgaggcagcaccttcttgtgcatggcagtcaaccaagccaatgagccgtactggttcgagcaacagagacttgccgtggcttcatcgtgatttagtcccgtgggattctcaagttagattcttttacctcaagtcacaagatatagttgatcttatacctggaatgctggtccgcgatcttcgcactaagtatacgcaacgaccacccttcgcaagcacgcaatccagaattgcttttcccggccacctgtttgggagcatgactgatctccacggcgtttctggggtgggatggccaattccgcgggtgcttgaagttcacgacaggaggtacccgatcgttgtcctaatatctatctcgcaatgtccacctcccacatcgaagtctgcggttatcattcttctcttcaaacagatgctgcagtatgtaacaccgtgatttaatctcttcatcacttatggagcacgctgctctctctgcgcccgtggagatggaatcagaggagattctctcgcgaattatcctcgttgtttcggtggcttccatgatagggtcgggatggattattatcagcttccttgtaagtatggaaacagtgtatctacctgtctgttctgtttgtgacacaaatcagtttgtaccaagtctacgcactttccgtcatcagttgattctaggtgctgttcttcatcccgataatgcaatatggctgccactgatgagttcaggtcttggaataagcgaatttctagcctcaggcaatgttgtcatctcggctagtgtgaataccgtgggcattgagatatgggatccatccctcaaggcattctgcagcttcaatggactcatggttcagacttttgtggtgcagggtaagaaccaatatattgattagtactggcggtaccatactaaccgttagtactgctagccgactactggatcctttcgattgcaatctgcacgtacctcatactgatggactatgcccatgctgcctcgtgggtccagaaccacagagccgccatctggtgcatggcatggggactctcgatcctatgggcagtgcttggccttgtcgtcgtcggatacgggtatgccggtggctgtatgtccccctttggctatatggtcttgagacgcacgattgatagagatcagggtgctggttcaccagtgatcgtgtccgcctttttgtgaacttcatcccacgatggactatcatccttgtcatcatgggtatctacacccgactatgccttctcctctaccggtcacataaggccatctccagcgaccacgaacttactctacagacgccgcatccgcaccaatggcagcttctggatattagtgatgggcctagccaaagtactcattcgtcgatcccgctgaggaaggttagtcaatctagtatcagagttttcggtctcatcctgatgaccggatgactaggtgtcacttcagatgatggtatatccgaccgtctatgcactggtttggatcatccccacttccgtgcgcgtctatcaagggatgacgggaaagcgagctccactggcattggagattctagaaaaggtgatcgaaacaagtcacggcttcccataaactctattgacagaggtatagatttgcatcatgtcacagggcttggttgatgccattatctacggtgagtgatacaggcagtctccccaggcagtgctgatcggaggtggaaataataggattcaatgagcgttactggagtggctggagggaccggctgcattgcctaggacgatgatgcactcaatgtggtaatgatagtgacataaccacttgtgggttcaattgtttgatagctatagttttctgtagtagggtagatgatctgcggcgtggatagccatggcacctgttccgacaaatcatgcaccgttccagacaaacttccgacaagatattcggacttgatcaccgtccgtcccagtccatacttgctagggcctgtggtaaataggcgatccaagggctgtcttcactactcggctggggtctaccgtggaactacacctattaatggccggctcagactgccggacatttccgaggcagagatggggtcatcatcttgggccagatcattctaagagttcattgccagtggaatctgcgacacttgactgggaatgaggatgaatttggtggtttctgcaagaaccgcgatagtagtagacaattttttgcagcacgaggaatggcaccaagatatagaatggatttggaccatcttagatgcacaatcgagttgctgtcaaataattcacaaccaccatctgaaaccatcgatctgtcaaacagatttcattaggcatgactcttatggctggccaactggtggggggaacggagagcccgtgactccgggccgctttcgtctcatcgcgcttctgctcgcccaccaacgactgtaaccacaacggcgacacacttccgtcttccctatcggcatccccgtcgtaacagcagcagcagctacgggcacgtttcacaaacattgccatgatcggtctgttccggtttatataacttcgaatcttcgaagacatcgtaacctcacattgcgagtcattgtttgagtccgcatgcaaacaatccccttaactttcatgatgtcattgactttcacctttcctcatgacgcatcctaaccacactttcgagtcaacaatgaggcccatgacaccacgactacgccaatttcacgtgggcagttcgatgactattggcagcgcgccagaatggcttctccccctgcacgatcaaccgcctgcagcagactcgctcatcgtcccgaaccacggtcgcgtcgtagtcaattcctcgagttcgacctcacggataagaggcaggcaagctatccggaggggacgaaggccatgatgtcaggattgctcagggttcggacttcaacgttggtcctcgcatcatcgacccttgcggaggaatcggaaactcatataccgtccagcaaccacgttcgtcgagaggccaattgctcaatgctatgcttcctaaccattcacctccactgaaatgatacagcaatggcttccactcgtgctaagggatcccttgctgtcaatgggggtacagcatctctcccaatcctgcgggagacggtgaacaccgtctctcaggagtgcccgactcgtctcgggcttacggcaaatgaaatccaggctaaatcacccaccctggatgtctttttcgacactattgctgccgaacggcttcggcgcatgccccccgatgggagtcgccttgatggggctttgcggcgcgcctctcggctggccgttgccgtcggctccctgcgggactcggtctacagcttcatggacggggctgaggaggccaccaaactgatttggggaaccaacctcctctttctcgaggtacgtcttttgaactatggtctgaaagtattgccatgcaggtgactgacataatcgggtagatggggattgatcatatcgatatccttgagagcctgtacggccgctacggtcgtgtcactttgggcatttccttgttgcttcagcaggagactttcttcccggtttcacggcccctccagcagcaggtcgcggaaatctatgcccacctgttggagctagttgctcacatcacctcggagtatcgtcaggctacacggacccagcaatggcagacgatgagtactgctgtggacgccgccttcttccgctatacgaatcggttcataacccactggcggcaaatttttgctcatgtcctcgagtctggcacagccaagcagcacactaccgtggacctccccgctatctatcagttcttggagcttcaggaccgtccgctccagatgttgctcgaaggtcatagccattccttggctgacggctcattcacctggttcgagccccatttgaccacttttgccatgggacggcgcagcatgatgatgatccggggtaatccgggctgtggaaagagtgccttggctcagtggaccgttgaaagactgcaagcgtcctcggagtatgatatctggaatgtcatacctatcgtcattcggtcggacgtcccaatctcgacattgacgctcagtatcctcaaaggaattctgatccagatgcttgatcattgcgtgagcagccgtaagacccaggacgccatcctcgcggctgtcaccggtgctatggaaatggccacatccggcgcttccgatccccaggtggaaggtcagctgtgggcagccatcaggaccgcaatccagtccaacctccacttcatgctagtggtcgatgggttcgatcaaatgaaacatgcggagaccactgtcagcgcgttcctcggcttgcttcaggatactgtcgcgaataccccatcgaaactgatcatcttcagccgaccaatgtcgactgacctgctccctattcgggagacaattaatacgcaccagattgcaatgaacacagccacgactcaccaggatctccaagaagctgtgacagatattatgttgtcagactcctctttctcggggctagagccatcccagcgggaatccctgactacgtctatcgtcaaccgctcccaaggatgtttcgtgtgggcacagcttgccgctgaggcagtgcgccaccagaccacatacaatgaaatgacaacagctgttcacagaatgcccaacacgttaggtgaccttattgactaccacctgcgcaatatcaacctcaaccgtcttggtacgcaaagcctacttgcttggttagtcgccagtgagcggccattgcgcattccagaggttgagcagctgttgtctgttgacctgaagacgctcaaggtttcagctcgtccaccgaatgtggagcgtgatgtcttccagcctcttgggcggctgatctccgtgcgtgatggcttcgtttctttccgccatcccatggtccgtgagcacctccaggctagagcccagatgcgccaggaacttccattctctttggcagacgcacactacgatcttttgatccgctgcctggcctgggtgcgtcgctcggtatccgacgagatctctgtctcttgggacaaaatgagtgttgaggtccgtgaccgctacctggacgcctatgtgcttcttgaatatactgcccggtactggcttgcccacatgctatcttctccgatggcctcctccgaccgcgagctctcattcccaaccgccttccggcgctctctacctgacactgtgttattcgcacagctggagctcaccaatcgtgagtcgcaattcagtcggtcaagcattgttgaattgtatcgactgtcagttggggtccgccgtgtcgtgctaggaagtgactctccggcagtcctacaaagcctgatccttagtgctcgggcgtctgagaaggcgcgtacatcctgggccaatgatcacctctaccaggcttggacggtgagccgaagtcagcttggaactagcagcaaaattacccaggagctggagcagatgcttgtgtcctcgccggccgccggtcgcctgactggtggaggaagcaagtctgtcacattgagggaaatgacaatgaccggttggggcaagtccgacattagcttcccccagcggcttcagtatcttgatcgacttgtcaacatgtatcaagagaataaccagaatgatgaggcatataaagtttccaaggacttttaccgccagactgtgaagacctacggtgctcactcgtcggagaccatgcaagccgctgaattccttacgaaacacttcgacatcgcacctcccgacgagctagctttggaattggccagcaacaagtatgagaacatgcttcgctccatggatgcaaccgacccgcgccgggtggcttactcactctatctggctcaactgtatgagcaaaatggtcaagtgtccaaatccgagaccgtgctgtcccgactctggacaggactgtcggctcgcgaggctgattctaaaacttcctgggatcagaagaccaaggttgctttctactactcgcagttcctgcgtcgtcagggtcaatccgaccgggccacgtccatcctccgtgaactctcggccgacttggaagcagagggcggcgtcaaatctccggaaatgctaaagcgggcggaggagctgcggggcgaagcgcgcgaaatgaatctgaccgatatggaccgcgcactcgcgttggagatgtggaagtactaccagtcatctggtcaagtgtactcttctcaggcagtgtcattggccgagtcacttaccgagggtatgattcccagtcaggatgccaccacgactgaaaccgaatacattatgtcgggattatctcccgaagaccaggagcttctacccggctggatagacagcctggcctctgcaggtgatacccgcaacatgaagtccataatgatgctttgtcaccagttgtctactcgttgtatccgggaggaggagtggcgcaagggctcagactattcctgggctgtgcttaagcatgcctggcctgatgtcgaggatgcccaaacgagggccaaattctcgtcagatctttccccactgatgtccagtcttgccctcgactacgcctactgtatcttccgtcgcttggatgttaagagagccaccattgtctacggcaatgcgtttaaggcttcgatcaccgcggaccaagttgctgtgccagccgtcactacagtgacgaagacagtggtcgagttctacgagaccacattccagtttgacaaggcgttgatcctcctgcgacaagtgagcgagttctttgcctcgcgtttaggtgcgcatgacaagcatacgctggacagccgctattatgaggccgacctcgctttgcgtctggaccggcgtaccgaggcagaagagagctatcgtcatatctacaaggcttgtgtccgtgaaggcaggatctcttcttccggtgttcgcgcggctgtggctctagcaaacctttacgagcaggacaagaaatgggatgctgcactcgatgtctatcgacacttgtggcccacactggtgcactttgatgaaaaggacggctatgaccgtgctttgcaggaaggattgcttcccaagacttattctgggtacatggcaattcttgagagcacatctggtcaagcgggctatgaggagcgttaccaagtcgcatcccagcaccagcagctgtgtcgtaagctgtatggaccgaccagtcaccgtactcgggacgcaaccatgtatctcgcagcgctctgcgctagcagcgaccggcatagtagcgaggctattgacttgtaccgacaggtgctcaagaccagcgactgggtgtcttccacggaggcgtcacgctctctgcctgacatgacacagccgctgcccatggacatcaagcatcgcatggcccagcttcatttgcgcaacaaggatacgtcgcaacaagctcgtgcgttgtatctcgaagagctggcactctccaagcagcaacaaggcctttccgcgcccaccacgctcatgtggttacgtgagattgctcgcatgtactctctacaagataacatcgaatctcgtcggagaggtgccgatctgctgaatgaacacgtcgacgaggtcgtccacgttactgccaaccatgacgctctggtgtatcgtgcccgccgtctggcagagatttacctggagtgtggatacaacaccgagggctgggcgcttatcgacagtttgcaccagcaggtcattcacgacacccccgcggcacagcggaagaatctcgaggagtaccgaccggctttattcgtggcatctttcgaagaggtctttggccgaacacgcacctcgcgccagatcctggacgacctgtctagcgaaggcgaggtgtacagcgtcttccagcagagcctggctgggcatgatctcatgcccacccttgcagccggcgagagattgcatcgcttgcagacggaccagaagcgcagcgcagccgcgcagggcacacaaaataagctgtacgatttcttctgcaacacgctttctgtttctcagcaagcccggaagaaggatgccgtgtatcagttctattccttgtgccggcgcgagtcattgcatgatgactacaatctcaatattatcacccaaaccaccagcatggtccgggatctatgcaaccagtcgagattccaggaagccactgatgtgactagtgtcttccattccttcgtccatctgaccgatggactccgctcgacggagagcatcttcaccgcgatcaagctgtgcttgtacctctgcggctaccaggtgaacaagtgcactgagactaccacggcgaacgcaatgtccctggagtcgaagacacttctccaggaggtcatgaacaatgcacgggatgtcccgatggagttctcggaacttccatttgaggagctcaacgatctggtgacagtgctgggagaacacgagatgttcgaagacctcgaggtaagttatcatcctcttaactcatacggtatccactctaacgaaacaggctattctcaccgatctctggacctctcggattgttcaaaagacctggacgctgcccgcagttgtctggattggccggcgtctggtagagactcggttctgccgaggccatgtcacggccgccacgacgctgggcaaggacatttgctacaacctgcgccaggtctggggcaactccgaccccgtcactctcgaaatgaacaagctgctctccggactgtacacggcgtccggaaacaaccttgctgcggctgctctgcatgagacagccctggcagagctgctgaacgacgagaccgaggaccagtcagccgctgtcaacgcagtcactcaacacctggagctcttgcagcgggcacagtctcgtctggccaaggaaggacagagtgcggcgatcgacgcgacggcggctcaggaacgcgtgcagcagatcgcaaccaagtttggcctgtcatcggccaagctggagcagccttccacggcggacgattcactgggcatgtgggagcgtccccggcggttcagcttggatgttggagaggcagaaaagcactcgaaccatctgcgtcaatctagcgggtctgcgttgctgacgggcaatgcgggagccaagcggctttcgattactgctctgtaagggggtgaagtatcagattgagaaccagattgccaatttttgtaattaggtgttagggtgtttatagtgttctagtaatgtaataatattgcttcttctgataccttgatacagtatccctaagtctccaatccagcttttttcgaaccttcttggatacaggccatagttgtgcggggtatgacggtggcttatagttaataattaactagttagttaactgtgacggcggctgttcaatacttagtagaagtttttgtatgtaatccacgtttccttccctaaatcttacatccactgtcacttttaagccacctcaatggttcccaccgtcacactaccatactatgcgtctaacataccttgcccgctacccacagcttcagagatcaatgcagcagcacccaacgtatccctagcatatggaggacgaagaatcgttgaaatcggagaacattcggtagtgaagtttggaaaaggcgtgaaccttatcgaaggagagaacatatttgttcaagaaaaacaccagcatccgggtccctcgtgtctttgcgctttattcggaccctgctacggggaaaaactatattattatggaaagaatccccggcagagtctgcgtggtttcaagcaatttggctagaatcatggtcttagggggcgatcgtttatacaattatcgttggctgggaatctcataccgtagcgagagacggcatgcgtagtaagtgactgtaagataccggcggctaaagggaagggggggcgggcacggagtactctgttcccgcaggggctcggtcgatcagttctctctccgaagtaagttcgcagggtgctctgctcggtatattcagcagaatgatcagcagctgttcctcaagaattcgaaagtctttctgctcttcgcgacgaccccggatccttcaccctcgcagccttggacacctccagcccttgagagccttgacgacgacggaatgtgcacgacagtcaacagtcgcctcccatggggatcttttccgctacacttccggaagatggctgtaagtgctttgacatatccgctcaggtggcattggtctggctgaacattatgaagcgttaatgaacacctgcgtttatcggaacgcttcctcgaatttgatgtgcttgcgcttcaaaacatcgtttccactgcatctggtcattcagtatccgaactcagctcctttactaaaatatcagaaggtggtttcaaccgtgtgtttgaggctaccttcagcgatggaaaatgtgttctcgcgagattaccctatccaagtacagcgccagagcattacactgtagcaagcgaagcagcgactctggactacttgcgcctgcatgggcttcacacaccagaggtatatgcctggtgctcgacgaaagtcaatccagttggagctgagtatattattatggagaagttggatggtactcctctcggcaatagatggttttcattgaccccaaaggaccagtataagataatgacacaaatagttgaatgggagacgcgcttgatgtcgttgaagttccctgcctcggggagtctctactatttgaaggatattccatccgaaaagaggacaaggctagaggatccgagcagcatggcgttctgcatagggccaatagcccattatagttggtggcatgacgagaggggcattatggatattgaccgcggaccttgtgggtgaatataccaagtatcatacgactcacaacactaacttcaacgggagaaaaagggccatcaccaatcgacattttccgagcagctggtgaacgtgaactgacctgggctaaagcctatgcaaagcctcgcttgccctatgagcggctttatagggaaatctacaaatttaaatgtgtctcacccgatagtcacatggcagatcttgtcagttaccttaaggtggtacccagtctagaccataccaacaagttatccttggatcgaccagtgatgcgccaccccgacctgtagccgaataatattctcgtgtctgacaagaacgacattattggacttgtagattggcagcactgctcaattcttcctctgggcattgttgccggaattccagctcatttccagaactatggcgatccagagtcagaaatgctcagacaacctcagcttaacctgccctctgattacgattccatgtcaccgtccaagcagacttcgatcaaagaaattcatcgcagaagagtggttcatttcctgtacgccgcattgactaaaagactaaatcaagatcattatgatgctctcttcgaccagtctgttatactccgccaacgccttttcaagagtgccggtacaccctgggaaggggactcggtctcattgcgagctgagctcattcgctcgatatcgaactggtcagccattgtccagactactgatattgctcctccggtagagtatccagaagatgttgtccgggagacctttgacttagacatgcagcaaaaagaagccgatgtggcaatggaacagatgcgacatgctttaggtgtcgatgttttgggctgggtaccaaatgaaggttatgaggctgcgagaagactggcatgtgacatgaaggttcaaatgcttgaagcggcagagactcctgatgaggttattgctatccgagatcatttcccttttgatgattttgacgaaaggagttaatgcagttcttgaggaatgggtgaggtttgatgatgaatgctcgccacagcaccagtaggcccgacgatttatcccgagctgcctactttgaaagcatagatcgggggcagcttaagtgtcttggtccaaattgtcaccataatgtatagatcctaaatgtaggataatacgacagatgatggttcgacccaaagagaggctaagcctctaaaagtggccccgtcgtccagcaggagtggggtggggatagaaaaatagcaaaaaaataatgaccagtctggggctcgatcccaggaccttatcggtgttaacgatacgtgataaccaactacaccaaccagccattgcttgaaagagctgggattatttgaaattatattcctaaaataatgttcgacaatggcattgtgattctaagtaaatcttcaggtcatatatgtggatcgtcccttcctttcaaagcttacaagcacaagctcaaccttaatctatatccactcgcacttcccgctccctcatgcgctgtactgattcccagtactacttagtctgcagaccagcttacagtctggcctctgaccacggtcgcggcacgtgttttgttgtctacctgggtggccttcggaagaactccgcaagcatcaatgactttgggccacgtctcgatgtcatcagaccttctcaacattattgagatctggggctcgtatctgtttagtttatctctggcattcaacttgtgtctcacagcaaaattaagtagtatctggctccagtcctgcgttcaacaaaccagcgggctctggattatatatctccgcctacagctggtaaccgcccaacagttatcactgaacacaactggatcatcgagtcctctcaagcaggctaccactagtactcttaagtactagtgcatgtaataccattacgacgaccatgcaggatgttcacaacatgtcttctaccagaaaacgtgcgtaacttccaactaccacaaaaaataatcatgtgctgacgtgatactacgactcattaattaactagttagttagtgattaccttcactagaaccacgctaaagcagccttgctttgtccagatcccgtgagactttttcccccacctcgtgtaataaaaacatgacatgggctgagaggaggtgaattgcggggagatctaaatagacgattcgcacccctggaaacctatattatgtccatctattatcgtcggatttcataacagttcctgcgcggcctatgcagtggctaaattaccatctcgataaatcctgttccctgtcggtctgcatggcccggtcactagtgctactaagcacccggttaccctctagccaaacagattaatcgacacccgctagtggtatttaggccccctctggctcccgccccttcttccctgcgtactattcgaaagcaattccagaaaatcccaccctagtcgttgttcaacaatggcccaggtgcagctcatcttatccagcaaacaccggaagagcgccgggaagagatctaggacaggttgtcgtacctgccggtaaggaggggaagcagtacatggaaactgatggcacgagacactagcactaaccgaggactttccatgcccagaatccgacggatcaaatgcgatgaatcgccaggacaatgcaacaactgcgtctctgctaactggacgtgcgacggatacgatgcgtaccggttgccgcagcgccgaggtctacaggatataggcactcggctgggttggatgatgacgtcggatgaacaccgttgttattcctattttcaatatcgttccgttacgaatctggccgggttcttcgactccccactctggcagcagttggccctacagatgtctcgcactgatccggctgtatttcatgcggtgaatatgttgagtgctgcgcaccaggagtcggaattgcataatatgcagatttctgcacggtcacgcattgggagccagcagtattacttttctcttcagcagtccacgcgggccatcgcgctcctgaaccagcgccggaactcccaggatccccagctgcgccaaaccatcctcctgtgctgtctgctctttgttctattcgatgtgcttgtcgcgcagtatgacagtgcgttcacgcatttacacggcggtctccgtattctaaaagaactcgaaatccaagggaagctggagtcggaggttgagccatcaatagttgccgcatttcgccgcctggatacacaggcctctctctatgatactcggtttccgatcctaagcctggagtatgggaatcaatccccgcttaagttgttcgaagcaccaacaggcggctttactagccttagccaggtacgagagaaaatcacagttctattcacagcgggtatacccttggttgcaaggagctggagcctgaacggttccaacatggagaccaactacgagtcactctaccaaagtcaacggcgattgctagatgctttcgctgagtttgacctacatttcacgtctttccgcgtgacaaaatatcatcagttaagcgagaaggagcaattgggagcagatatcacctacttgctttaccttggtcacactctcacactcaaaactgtgttaattcgtggaccagtgccagagtctctggttccggaattccttgcgctacttcaggcccatgaagacatgatcgagaagctcaagtccgtctcgggccttgtaatggaccacgtcatgattgcccacatgtaccttgtggccacacaatgcccagacgtggggattcgcatacgcgctattcgtcttttgcggtcatggccacattacgagggccttcacagctccaatgtcactgctctgatggcgttgggtgcgctcaaaagggactttcccaatgaagacaaggccttgtcgatgttgcagacgactgacgcggagaatgaatttctcgtcgactccttggagtctatcaagaatggcgtgggagaacctacaattccgcttttcaggatgtctgagttgccgtcacgcccatgatcatgtagtgagcgataagcgtggactgcggatacgcattcgtagcttccactccagtcaaagccgacgttatccatcaccacacgtctcgagcatatttgtagcacagagcgattccgagaacaggaataagccggggccaatctgacgcgcttggatcctgccatagggtattcccgagaagtccgagggagcccgagggtcttctccataagcccgagttgcagatctgctgccagccctcacaactgacttgaatggaccggatacacgagatgacctccctagtgtctgaccctacgccttcagtatcattcccctcatgaaagcgcagccctatccgccctggcggatacattttctcgacagagaaatcatgtggtacgctgtctagctccgctcggagctagttgcaacgatgctaagcccgaaaattatccccactatcactcacggccgagtctgcagtgggtcaccttgtctgcgattaggtttctgggcaattcttaagctcatcaagccgccctccacccaacacatactgatttctttccttgtcgtcactcctcactgcaaacacagtcacaatgcccattcaattctcctttgctgccccttgctacgaccgcatggtcccgctcgcgaccggcgaagttcgccccgcgggacttgatctgaactatgtcgaagtccagcatccccgcgacgtgtttgaccgtatggtccgcaacggcgagttcgacgcctccgaactctccagtagcgaatttattacccgccacgtcgccggcgatcgcacctttactgctgtccccgccttcccgctccgtacctttcgtcacggatacatcgtcgtcaacgctgaccgcatcaagtcccccgcagacttgtcggggaagcgcatcggtgtgcaactatatactatgaccgctgctgtatggattcgcggtctactaatgcacgagtacggcgtggatctgtcgagcatcacctggatagaggggcggatggacgcgcccggggctcatggcaagccatctgtcctgattcggagagaagggggcaagcctctggccaacattgaaaagaacaacagcgggaaatctttaaaccagctgctggtagacggcgagatcgatgcgaccatcggcgcggaggtcccatcctgtctgtgggacaacgagaaagcacctcatatccagcgcctgttccctaattataaggaggccgaaaaggaatactaccggaagacgggtatcttcccgatcatgcacctggtcgctatccgaagggaagtgtacgaccagcacaagtggatcgctactagcttgtttcaggcgctgaatgagtcgaaggagttggtccgcaagagaacctacatgcctggtatgatccgatgtatgttgccgtggctgcgggaggcactggaagaaactgtcgaggtgttcggggaagattgctggccgtatgggattgagaagaaccgtaagactttggaggcgctggtgcagtacctgtatgaacaggggatgatcgaaagggtggttccggttgacgaactgtttgcgccggttcaggaggcgccgtttgtgattcactagtaccttaatcgttgccatcactctgtgtagcctgagctcggtgcaatagagactcttattagcagctcccaggtacttttgaacccctagaactacacctagtagtgttgacatctctcgtctcgcaatatcaattattcttcttttcgcgcattgtgatcaaggaccgacgaccacaggataggcgaccctggcgtaacagatccactaaaagggatgtatatcctcctccagcataacccggagttcgtgctttacatctccaagaaagtacgaaatacgcgcctggcgctgatcctcttcgactgtcatgaatatacctcgcaaggatggctcattgtgaacatcggccggtgttccactcgcatccacattgaatttattcaatgcctccactttcatagtatgaaccgccagctgcgcacacaagttggaatcccaggtcccctcgcgatgaggccaagaacaaagcatctcaattgcgcgccaccgaacattgtaatcacggcagcctgtcgccacgagagtcagaggtggaatgatgcccatgtcaaagcaaacactcgggcgctctgggaatgtgtgcatgattgcagccgctaaagataggatattttcgaattcgggcgtgtactgatcaagtaccggctcgtttccgtctaaaaggcaggtttggagggtgagggttgcggctcgctggtgaaggtggacaacgtcggctcctcgtcgctctttcgggctcatctgagggtatgcgtcggttcgaaatgtatcgaatgctcgtgcaaatgtgtctatctgtagacagagttcgagctgctccttgtatagtgtttcgtagtccgatgcgatctgactgtgggttgagccccatgcctttgctgtgaactcaagaacagtgcccatcacgcgatcgaaagctcgacgcgcctctgcaagagtatgaaaatgaaaaacggaggacttcccattccctagctggatatggtcctgcttaccggtaaaccagatcggtcctcctacgccgaactgggtagactggacgtccaagtgcgcaaatgcctcgacaagacaccactcgaccggaggcttagacattgccaccgaatcaagctgtctatgggcgcctagatttttcaagatgtgtataccaccatgcagatgtctaaaagcgttatcgtaccgaccgcgcagcaattcagacaacgtgaaaagcaagcagcacagcagagtgacctctctcagacggggatcctgcgatgtccgtcgcgcattgagcaagacgatggagcgtcccgcctgttccaaagcgaagcgatgccaagtattgtccaagtcctccctagcaagcggcatgcctttcttctcggcatcctggtggatggcgctcaatgcgatagctgcgtggtatacagcgggctctgcatgactcaactggaggaccagtttctgccatagcgacgagtcaaaccatcctaaaaacgcgggcatggatcgatgctgaaaataggcgaacgctcgttgctcgtcggaattcatcacccagtggatcccattcgcgagtgaggcgggcactgttatccccaccactgcttttccgggtctcctcacctcgcggggtaagcggtggagctcatatccatcgcaggttcgacccgtagatgtacaattgatgcaggcgcctggggtttcatcgcatttcttatggcgggcactaaagagcgcgggtttgttagcagagtatctatggtagtgtcgtgcaggctgaactcaccgacaggtacgacatccagtcttggaccttcttcccccagctctcttgcgggtggatgctgggggtgttgtgatttcggatgatcccggagtgtcgaggagcataggtcgagctgccagtagaattgaaaatgattagcctggagacaaaagaaattagattagttgcgtgtgtgctgcgtgagacgcgataagcacgagattacggggcttaagcgtggagcccacgtggctggcgcctgagatacgaggcagcagcgtcatccttccaactgagggtttctccagtttgataggcagcaacatgttgaagagtaggcagtagtatagcaaagatttacttctggcctttctctgactattgcggctttatccatgagtctttagtgggtgttgttggacctgcgctgcgcatccggtaactatgggcgcgggataagagacgtgatgacaacctaataggaagtatcggtacgcgtgacgctcctaatactcaaggacctatcaatcaccccagactggcaagtccaaccacagaaccacaccctggaaccgagtccgtggaacatgtcatcgatcccggccgtatatccgaaccccgcatatccgaggacttcatccgcgatcaactgccgtggggctcggcggtggtgcctcggtgcctgcgtcaggctgaccttctcttatctgatcttcttaaggctggtggttcgtaggggggattctgattcttagaatcctctgctttccagccaattcagatatttcacaaaaaatggctcttgctgagactacccccacggtcgagatggcccttagtttcgaagccatacacaccatccgctcttatggcgcccttgctctctcaaactttcacacaaactgactcacaacaccaagatccatatccgaaagaactgcccaacggcaagatagataccaagtacacggcaatgtggaccaccggaaatatcggagtgacgccactgtcacccggacccaatccgtggtggatgctctctcggagatactctatcaggaaaccgggagatcagataaggaatatgccgaacccccctggcgacaatcccccactttgcctccggggctaagccttctgccgcccttatatagtcgtgctcttgctcgctcggtcgcgcctttatcatgtttctaccttcagacagacctctaccttcattgatttcattgattgttatcactgtaaccatagcattgattatctcgtccattgctccaagaataattcaagatcgcaccgaaaactccaacagaatggccgcatcttcgctgaagaatgtcatcgtcgtgggcggttcctatgtcggaaaggtaattccacgcgcaactctcagttgtaaatgcagaagcatgactgacagcaagttcagggagtcgcacaggagcttgcgcgggttgtgcccaacacgcatagagtatgtcctacccactgcccagctatcctggtcaccagactaacctacgtccgcaggtcctcctgatcgaaccccacagtcacttccaccacctcttcgcatttgtatgtgacaacaccgtcctactggcccatatatcgctatagacacaaactaatccgcaccccagccccgattcgccgtcgtccctggccacgaacaaaaggccttcattccctactcccgcctctactcctccgcccccaacgccacacaacatgcagtcgtccaggcgcgcgttctctccgtacagccccaacacgtcaatctcgatcgtgactggcaaggcctgaagcagattccattcgagtacctcgttgttgcgacaggcacgcgtctcgcccagcctgcagccatgacagacgacgacaagccgtcctccgttgtctacctccaaaaacaccaagccgacgtcaagaaagccaagtctgtagtaatcgtgggcggtggagccgtcggcgtgcagatggccaccgacatgaaggaattatacccagagaaggaaattaccgtggtgcagtcgcgcgaccaattgatgccccaattccaccgtggtctgcatgaaatcgttaagaagcgcttcgaagagctcggtatcaagttagtttcacttctcccccttatctatcagatcatcccaactaatctacttcagcctggttaccggcgcccgcatcgtcgtccccgaaaccggcttccctaacaacggcacgcccttcaccgtccaactgaacaacggcaccgaactcacaaccgagttcgtcatccttgccacgggccaaaaacccaacaacgacctgatcaagactctccatgcttcttctcccgattctctcatcaaccctgacaacggcttcattcgtatccgtcccaccatgcaattccaggacccgaagtacccgaacctctttgcgctgggcgatatcgctgatactggcttgcgcaaggccgcaagacccggcggtccccaggccgcgaccgtggcgaagaatatccaggcgatgattgaggggaagaagccggaggaggcgttcccgccgttcccgacggcgattcatattacgttgggattggtaagattttttttttttttttttttttttttgttttatttatttgtcttcgcgatatggagggatgctaatggtctggttgtacagaaatataacattgttttccggaatcctaacccagccgagggtcagaatgagcctgttgttaaggagtcttgggagtaagttcctcaaattctgaagctgttttatattgttgtggaatgtaagctaacaatttgacagctcgcaagaagacatgggtgttgatcgctggtggcagcgtatgggatttgaggaaagcggcgcccctcaataccatctgtaaagcggatgcatacccttattgtttatgataccattttatgtagatttgatagacctttcatagaggatatgataccgttagtaacgatcatattggttattaattgaacaaatgattcaaaatatgaatgacacattttgcagtattatatgaacggtcatagtacatgcaactgatgatacaagatgaaaacagatccgataacaaattcatccacttttctcaaggtatgttatagtcgacccccaaattagagatacattagaaattaaacgttccagtataagcctgtacacttatactcaaacatatccgtgaaagagtgactttggtcggaaagtaggtttgccatctaggcgtggaaagggcgagggtggtgggggtccttgaagcaagaaggaacgttctgctcgtagtcgcatgcgctaatcttggggttgaaggcagtgccagcaccgcacaccttgtgggcgggctcagtgcccgggatgcactggtagaaatggtggcagtcggcgggatcgggccagacagcgctgctctcgcaggcgtgggccgcagcgctgttgacgaggagggagctgatgaagacagcaagagcctggtaggtgaagcgcattttgggtggatgtctggaactggttagttgtgggatggatgaatcaggaatggtgtctaactcacggtttcctgtggataggttagtaaaagagtgattggatttggtggttgatggctgttgtgctctggttaatgaagatgaaaaacagcaggtcaacacctcgtatttatacctgagatggctccttcggcgtctgcttgtgtttatagtaggatcacgtacggaatgataactttcatgaagaaagggatgagccagtgtagtatctactggtcttgtcaaattgaccaagatgaattccccacacggtatcaccctaccacatgcgggtaatgcaagggatgcaccatttcgaccaactaatgggcccaatgttgtcacaagatatcactgattggaagccagaagagaatcctattattgtcaagtccacattcgttgaataacctgagttggctgcaacgcgtctacctgaggcacagccaaagtttccatagtagagactgcatgttatggcaaggatcgatgggatgcaagccgctggatccactggcgtcaccccttgctccagccccacaagcatggccggttccggcacgagtgagggtcagggatctacatccccggattctttatccttggaggcctgcagcatcggccactatactgtttctgtctatacagttcattgagggcgctgaaggcggacgcgattggctctctaagatggagttggcatacacatttgtgtccctggatagcggaaacttggagatacgtgattgctcaaagttgccaaagttcgaacgattcttcaccgcatcagaatttagtccgagctttaatgccccttaacgagcctataaattgaaagggatagtaagaatgcagccgggcaagtttaaaggttgagagacagaatgctcggctgccttgttctcgtgcctagatagactcctgggatcgtgacacaagggaaattataactgccttgtcaataaacaaaccagatagacccgcggccaagttcaatgtagaaccgacattctcgaatctgggtaagggaatgagcgagaaccttgaattcttcacagttaagcgaaggatggagacactggtgggatccacaacgggaaagcacccccttgtccggggatcatcaccgcctaccttttatgtcgcggattcatatgacaaggccagcagtatgagccattcatcatcttgctatcatgcataccgcgttcaaacagaaactgacttgcaaatgatcgctgagaaccgcatatgcatcagtggggcatacttcgtcgtgcttcttcatactattagctttatcgtaatgcaaccgtctgtgggcggtgtcaggcagtaacacaagctgaggccattgaccggtcttcactctgaaatcaatcgtagccaaggtgccattggataggaacaggaaatgcttctaatggctacaaaaccaacgatcattgcgttataatcactgctatggttgccagcatgtactcatgctccgtgatcccgtgcagtcggcaatagtttccattgatgccgctcctatacaggccttggcctgacaacgtaggtttatctgggataaggcacttgactgtcttcagcaactgaggatatacaggtgtaatgaaccagccttccgggatggggcccatttttttactttgtagtcccgaaacctttaacgtgtcttgttcttaagtgtcatcgcatggaactcgttgaacaacggccgagaatacaacaagccgctggctagcaccgccattctagattcaagtcctgtagctcgtggtctaactttacatccaatgaatcaaatacagtagaacgtattttcaagaaggtctaggccaacgcaattcactcaacccgggcgtcatccctgacagcatgaagtcaaaagatctcaactccacaccaagagatgaagatgaaagaatgacgaatgaagctagaacaatcaggcactgaatatataagtaatggggtgagcagttctgttcgagttgtgtacaataaccattaccacaaaaggcatcttgaagtcactctaatagagaattaaaacgcccttcgtggctataaagcgtgagtattcctttctaagacgactagttatactccgcattgtctgtgttatttgaaataggaggtttctggaggaggagttgtgaatttgcccgaaattaagaaaattggggacgggcaagtcactccggacctccaatcaaacgcagattcattttaataattcacatttttgattcacctttcagagaagtagcccttgtggcgcaatcggtagcgcgtaagacttctaatcttaaggctgtgggtgatccccaccaggggctttttttttttctacatttttcataatgtactcttaaggaactataattttagagggacaatcaatcaatcaatataaccccgaagctcgtagtcccagctacactgattaagagagcgaatcagtactttaaaacactggctggatcttggtaatccctctgacagtatactgcctagcaagatgccggttctctaatattagtaaggtccctccccggcaaagtccgagatggatgctgaatgttcagtgcaagaaaggaaagggaaggaaggggcggcgggtacatggaacagcacatcaacacacgattcgcgaggcagtggactggtatatgccccacgcttgaattgttccagcaagggatgagcattataggcctggccataattctggtgctccgactcagtcgattcccctttccatggtggatcctgaaagctctgcagaatcgagcttcaagtagttgcaatgaggcgatgaagatcccggtagtaaaccctgcatgaccatttcgctgcacagtggcttaaggtacggaaagataaagttttcttgcagtagtagctcctaaggctggttaataccaatagcagtccctggcagtcatatacttacattcctcacgcttttcatcgatcgcaaactatctcttgtctgaatgaccgggtgaccggacagagatattcagatttattgaagtgtgacggtccaatatcctctgccccttaaagaagactaatcctgatgtcgaggtcggtctcttggaagtggcggagaatattcatactgcttggatctgtctggaatcaggctcaagccaatgcctaaagctttccaacagagtcagcaagtctgtatggtgtgcaaatgtttcctttcagcgcgacaacgtacactctggcgtatttgaatagacgacttgatgatgctctctagttttgcgtcttctgcacgtaaccctcttacactcgatgatgttgcggccccctttgcagtagatgcaagttttatgttcagggcagtgtttgtcgatgtgtgccaataatttgcagtatcgacacgctcgttccggtttatatatataaaaacatgattccgagccagtgtgagctctactgtaggtagaaggagagtaccatgcaagtggttccctattgtttcctgtgtggctgtggtgtgtgattaggagatctctttatactagagtgggtgaatttagcaagtaataaagcaaatacaatttcaacttcactcgccggtatttcacggagcgaaaaccaggtggactacaaaggaaagtcccgctactatgagtgcaacgaaatgagacaccccgtgaatcttgaagactttaaagggattgaatacctttggaattgcttccagaaataggcaactgccatttgcctttacacatcgtgactcaaggtgacacaagtcggatgcctcatatgactgggctatcatcagggccatctcaggtgcatcccctagtcgccatctaaagctctttcctgggccactaagtaatagaagtcaaatcgatgtgacacagccccaaacttcaggtaagcaagtagccagtataaaattacaacgagctaataacccgagaagatacagtaagcccaaagtaagcatatacctgatcatagtgatgtgactccatttggcaggttttctcgtctaaaatgctaaccattgaaccaggtactcagattgattgcatgtatttctagatcaatggcagagtctctggttaggatttgaagtatagctgtgggtgatgatagatttgtgataaaacgagctagttcctacatgtgtatatccttttcattctttgttttgcttgttgctgaccgtgccagagtctatactatcgcctgtttctgacttacatagggatgtagaatgccgcatcatgtgacggcagtcgcgatagaccttcactggcacctgctgtgatctggtcttgtccaccactcagcacctcaagagcagcaatggtgcaagctaaaaagatgctttaaaagcgttaactctgactcatctattaactaggttttcacattctagctacgtgtcatatctcattatctacttccccagcaccattgaatgtgatcacgcacgctcaggcgctcttattcttcttctttttcccatctagcagtgctgggaggtcatcaacagtagacttcccttcgaggatatctgacaaaaagttagtgagagattgcgaggaacagaaaaccgaagagaatgcttaccatgaacagcaacaaacaacggaaattccttcaactggtcgtgcttcgagagaaagtcataaacagcgtaggccgtcgaagtcccctgcagtttctgaccgttgagctccttctgttcgatttcattgacgctgaccccctgctcgactgcgtgacaagctgaccggaagttccgcccaccgctacacgaggagatcacgtccgctagacccgcgctctcctcggtaaaggttctctcatccacagacttgggaaaccacgtccgaccaaacttgatcatctccaagatgccgacacgcataattgcagccttggcattttctccccagccctttcctgcaacaaaccccgatgctaaagctacaatgtttttgagtgcaccccctagagccaccccggcaacatcgcgaacgtgattaacatggaaatatgggcgggcaaacagagtctcccacagctcagcgtcgacaggggggagatcttttggcactgggtgtaatttgacatgcgtgggtttagtcttatgttgccgctgctcatcaatcttgattaagttttccttcggcgacccatcacgctcctccacatccattggaggggtgtcgtaaccaatggtcgtctcacaaaacttctccgcggccacctctggggcgatgttggcgccggacaaggcgccgcagtagatgcccagtcgctccatgataagttccgagtgaagggtcacggttccgtcagacacatcgacgcccttgatgcaagagatacctcgcgcatagggtagatggtgcccgacaacaccatcgagggtcttgccgataaactgatgggggaggttgaagacgagtaatgtagcatctttaacagccgatttgagatctgggtcggctacgacgttttcagggagtgcaatatccggcaggtatttgacattctcgtggactccgttgatgacctcggtcaatttgtgcttctggccgcctagtttggagtggtgcttggaggattcagggatttcgatttcctcctcgaacacccacatgcgcacttctggctcgaaaaggtccgaatgctctctggcgttctccgcaacaatcttggagatggtggatcccctagattacaacggtattagccaaatgcgcggcagcggcaagaaagggttggtgcataccaattaccggagccgaccacggccaccttgtgctttcgtgtgtgctcatgcatcttcagacgtgtcaaagcgatgcagttgattaaaattcgaaggctacgcgaacacgaatggaccttgaagactgccgaggtgccatttgatcggtggtttataatagctgggcgcgaaagggttctgacagcccccgggactctgatgtgagaaggacgtcatcgccctgttcacagcgagttcatgccctgcatactgtattccctccctcccccctaatttccccaatcaagatgacggggcctgacagtttggatccatcaataagggcacttcaaggccctgcccagctctcttcctctgctgtgactggcttagatgactgctgtacaaatccatggtttgccacggatgcctccgaccgtaccgaaaccaccgccatgaggtcattccggttcctgttgtgctcggacgatgaatgaccatcaaatcatgcacaaacaatatctttaggtatcaaaaaaaaaaaaaaaaaaaaaaaaaaaaaaaaaaaattataataataataaaaataattaatgaattaaaaggaagattggcaggtgaagtcaagtccagactagaagttccaggctattccgggtcattcgtgcgaaatgtgcggtgcagctgcgatggcaccgtaaccggatttgatgcggccaaacgacaagtttaacccggaggaaccgatcaatagcggctgccagaaatcgatcacaagcaataactccatggcagaccgtattggatcatgcgtcgagatagctctactgcattcttagaagggaatcagttacccttttcttttaccctccttacctttgccctcgctttgtccactatctgtcatatgcatcgtctactgtgtaatcaatatattctctcaaggcgcaggggttgaatgtatgtatttggtctaaatagatctcaagatgatggttgtaggttggtgtcagaggtggcggaggctcaggtgaggcctggctagagtcaatgattcaacataatctgtatgaagccaagcttatcactgatctggctaggccagggctcccctcttcgacaaacgtacagtcacgaaaatgaaagcttcactggggtaagtatccatgctaactatcagttttaccgcattattagttagtctagcagtgacgatagtcaaggtacgcaatgtgatagtacttctgcgacttcatcctcacctctcttgtcagcaggctagcaagcttttggaggctttcaagaaggagaattgggattacgaacgcctacatagtgtgttgaagtagctcctctacgcaggaggatatcgatctgctagagataactcgcggatcttgctacaccagataagggacatcccacgaagatcaggtaatctagtacacgcctacgcttgcaaaatgaacttcattctcttgatctttagctagcggggttatgtatcatcaactcagatgttgcgttcgtttcagtatttggtggtaaacaaccatcggatgccgccattagtactcgctttcacgggatcttactagcaatactactagttagtagtaacggatagcgttccattttgtttccgcgccgtaggatatatatcattcaaccaatagcagcgacactgtactacagagcactcacttttgactggatgaaaaaggcgacgggcatattcccatactaagctgattggtattactatggtagttatcttcggtctgccctcgaaacacagcatatccccttcgtagctttgtcgctacaaccggggagtgcgacttgtcactatcgagttgctataggtacaatgctggaatatatagccaaaactttggctgtttcgccatcgtatcccccgatggtctagttggttcatggcgttcggctgtaatggtataattgtaaccgaaaagtcaccagttcgattctggttcgggggacatgacatctttttttacccctgccttgacagccagctccgtgtcaaggaaccaacctggtgcgcttcaggcagtgaatcctctgggtctaaaaccactaggccatccggtgaatgactagaattctgagtccaacagctcagaacgcgcatcacttataagcttgcagtgaataatgtgaggactttccgggtcctcacactctgtgcatccataaacagaatctacttagcttacatcaacatgcccccgatagtctagttacctgttcgattctggttcgggggttattaaaacctttttcttgtcctgatagtcagcgtttgacggcctctataagtgtaaaatatgacaaataaagtcaacaagcccccgatggtctagttggttcatggcgttcggctgtaatggatataattgtaaccgaaaagtcaccagttcgattctggttcgggggaaatatttatttttctttcttggtctgccaactaattgactagtcatcattcaccattcacgtaatcggacaacgaaccggcgcgacaacgagccgccgctctgcctacgaaaaatactaacaatcgaatcaaaataaagtaattcagcactacccagataaaaatgcataaatatactaaatattgattttatcaaatatttagactaattataatttttttattgtaatcaccatagtataatagctagtattaagtattttcgagtatcacttatcttaatatcagatactgcagtatacatcttttttggggcaaattaaccgcaattaaagacttcatagataagttatagtattctaccttattaaaactgtgatagaataacctacccatcgggagcaaagccaccggaatgacgtattatagcgattatgggagtcatgaggtcatcgataatgattctacagcctcccgtcgcctataagctgccgactcccttgcctggaccactgatcccccaaggatcagtttatttcgtggatataggctacctttgtcattattatacgaatccatggtgtttagtggccgattccttacctagtcgacaggctttctagcctgacaagtagatcctatcacaaaaactctctatatatttacatagcttcatttttgactgaattaagtaagattaaatactgtatatcttggagatataagacggtgagggtcaccgacggctcgttgtcgcgcgacgcttcgttgtccggttacgttaataattaaaaaattgatacatatcatcataacaatcccccgatggtctagttggttcatggcgttcggctgtaatagcataattgtaaccgaaaagtcaccagttcgattctggttcgggggagatattttatttttcttcctggcttgacaactaaccgatgctattattcattattaacaaataaacaagcagcgtatatcatcgtaacaatcccccgatggtctagttggttcatggcgttcggctgtaatagatataattgtaaccgaaaagtcaccagttcgattctggttcgggggatattttagtttttgcttgacatataagcactatcattagaactgcttcttccgaagtgctgcaaagacgaagactgctgttgattggtcataaccactgtcaagccaccatcaagccaaggtacagcatgtgtgccgcagatcgaacgggacatcccactggcgctggaggggcatgagattacctgcaggacggcccataccatgtcgggattgctcaatactagttttactccttactgctcgttaaggacgggcctccatgcgggtttagcaactcaggtggccatacctatagccattgcttcttctatgcaactccccgtaatccaaaactcctgaaatctgctgtttcgagcttccgctaatgcaacgaagcatcttgatcgcctcgtggtgtttcataaacacaggaaccagttattcagtgtctatcaatcaacccccctctctcttctacgtttatattgtattaagcaagtttactcttctatattagtcaataatggcttgctggctcgcagccgacctagtggagtgagaagtaaaatacagctttgcctgatatattcataattgacagctgatatcaacaagaacccccgatggtctagttggttcatggcgttcggctgtaatggtataattgtaaccgaaaagtcaccagttcgattctggttcgggggaattctgtcaaattttttttttcttttcttagcctttttggtcaacagcccaaaggacatgtagtctcaacctgcgcctggtctgcaagtactaagccatattcatcttttctatttgaaaagtcagtctccaatatggttttttttttttttttaataatcctataggcagccatgcatgcatatatgaagtctcgcggccgcgggcattgttctttcagcttatctttcctgtcgcttgttctcaattaactattcaaagggtactgacaacctcgttccgttatctgttgcctcaactcattatcgccccgtctcgggcaaatctcacactcgattctgttatccacgcggaatcttgctcatcgatttctcttatctaagcttaaccggattaagcaccccattggggcgcgaccgacctgaggggcggaagggctgaattctgataggccacgatcttctcttcggtctgccctccgtggtattcaagcccaattctactagcctggctcttccaccttcctgtgtaaaatttcttcttgggcctcggacccatggatggcccaggggccggttgtttgctaagagctcgaaacagcgtctgtcgaatcacggcgcttcttcggagaagctgtgggcggggatctcagggcgcatcacgaatgagaaggattcgataacgccattttggcatccactttggcttcataccgtgctttttctctccccaatctttcaccgtgatggtcagccctagctcgtgccacctgcacaagttcaactttctagccattcggcgtgaagccgaccgacttggcagctggggtctgtgaaaatgctgcggtgctgctgctcgattgcgccatcgcccccttacctgatgcggagagggcgaggagtcactcgatcatggaacttttctataactgcgggctgcctcacccctctctgcgtcggaaggaactgcctgggtatgcgtcttttcaccccatccgcctctgcgcgctagatcttggctcttcaccatgggcctatccactatttttcgacggaagcgagacgatgcagcgccttctgatgccggcgatgtgtcgcccgtcgccaccacaacgggctaccgggaggaccagacatccgactccgtatccaaatcggcgtccgtgaaggaacagcccgtggatgatttggagaagagccagaagactgaagagcccaatgtggtcgaaaccgcagccgaagaggaccccgagatcgccgcgctgcccctcgaggtgcgccagttggtcagccttactgacgacccaaccctgtacaccattacctttcgatacttcgttctctgcgtgattttcgtcgtacccggtgccttcttgtccatgatgagccacttccgtactaccgaagctccatactccgttttctttgtgcagatcgcgtgccactatgcgggtcactttctggcgcgggtccttccagcctgggtgatccgcgtgccctttacccgttggtcctttagccttaacccggggccgtggagcatcaaggaacacgttctggtcaccttgacggcggcgtccggtgctacctacaacctcggatataccccgatcgcaatggcggagctctactatggtgagagggtcaatgctgccgtggctattttcttcatgtttgcgattgtctggattgggtatgctttcgcagcactagcccgccagcttctgctatatgaccccaacttcgtctggcctcaggccctcatgcagactacgttgttcgaaacgttccggaaacaggatgtctcatcccccctcgcgcggcggcagatgaagattttcttcctctgctttctgggaatgacgctgtggcagttcttgcccgaatacgtctttccgttcacatcttccctcgccttcttgtgctgggtcgcaccgcataacgccgtggccaacttcctgggctctgggttgggaggcatgggtctgctgaacctgtctctcgactggtccaacatcaattggaacggctcgtcgatcctccttaccccatggtggacgcaggtcgttttgttcctggccttcgtcttcaattgttgggtcctacttccagctgcgaaatgggggaacttggggtcttacaagcacggtctcatgtcgaattctctgctgaccgtgaacggaacgacctaccctacccttgaggtggtcacctccgactatcagctgaatgagaccgcctacgcggaatacggtgacatgtacatgggtcttcaaaacctctgggcgaccttctttgactatgcgaaagtgaccgcagccattacgtggattttgacctttggcttcgtccagatccgagataatttgatgaaagttattcggtcccggcggaaggcgtcgcaggagaagggacaaagcatcaaccaccagtatcacgatcggctcaatgttctccagcgaacatacaaggagatcccgctctggtggtacgtcgcgcttttcatggctggctttgtggctctaatcgtgacgattgcctgtggctatctgtggatcccgatctggacattgtttgtggcgctggcgagcgccgctgtgctggtggtcccatttggcttcctgtatgccatttcgaactatcaattggcagtgggatccttcaatgagctggtgtatggctacatggtcgaaactccggctggaaaaagccatcggcacccttgtgggccgtccacctacggatcgattgccggcgatgcctggtaccgagcacagtatatgttgcaggaccagaagatcggtcactacatgcatatcccgccacgcacggtctttttctctcagatatttggcactgtcctcggtattccagtgaactacgccgtgatccgatgggtactcaataccaaaggagactacctgtcgggcaagaagacggatccattgaaccaatggtctggtcagtccttgaagtcctcgaatactctgggtgtccagtatgcagttctcggaccaagccgcctgttcaaggagcaggagatgaaacctctaccctgggcgtttctggtgggcgcggtgctgcccccgatcctgtacattatgcatcgcactctaccgcgctggttacgcattgacctatggaacgttagcatttttttctccggcttggcggtcttctacggtaatatcagcacgggatacacatcggcgatcatcggcgggtatgttgttatgtactgggcctaccggtatcggttcgaggtctggaaacgctacagctacatggtggccgctgctttcgatgcgggtttcaacctgaatatgctgttgatcttcctcttctttggctcgggcaagcaaatttcgatgccaaattggtggggcaataactctgactcggtggagcggtgctttgcattggattgattcattgagctctaccattaaaagcgcccttctatgcggcttctagcgttcaggccaccttcaactgacgagggtggctttttcttgtatctaatatgtacatgaaagggggtcgatgaattggtctagaccgatctctcaaccttatgatagacgaaatgcagtaatgatatcccttctttggtttttgatttatggtaatgactctgcttgttcgacctactttcccttgggcacagtattcgggtggcgtatgttaaactacccgggggtgaaaagttattcgcgatgcacagaccccggtttgtgacgatcccccatcgcatccaaacagatggctgagcattttgcgggtgttcgcggcacgattggtcgatgctcgttgccagaaattctggatgatgatgccgtggctgaaactctactgatactcagccactcgacgggaagaaacgagggatagtcgatccctctccagttacttaaatgcgacgaggctttcattcctcaccatctgtcaatttacgttacgatcgacaggtcaaccggataataatgtccgttcttcgggggaaactgccgctctttgtcggctcctcaacatggacgtggtgggaagagctgctggtggtgacgctcctttggggactctctccaacccatggttacggaccaccaatcatattttgggcgctatttggattttcttctgcacgatcttactcgtcatgcgaatgtacaccaagatccacataatgaggaagttttggtgggatgatggtacgttttcttatgcttatatggattggactgtgagtggctggtagctaatgcagtcagcagtctgcttaatcctcgcttgggtaattgtgtaccagcaataacctcgtctcggtccttgcactcacatgtcttgtgctatcacagatcctttcgattggtactcaatctgttattctctgtatgtttgtgcaatactggcggtgcgagtggttgcagagaatctaacgtccctctctctgtagacggttacagctatggaggctatggtgtccacctggagtacctgactcccgcggttctcgatatctatgtgaaagtttgtcaccaatccttcttctactgtacactggcatcgtcgctgagagccatagaccattctctccgccgcgattatctacgtccctaccctagctgcggccaagttcgctctgctgatgctttactatcgtctgttgcacatgatccgcatctggagaaacatcatcttcctcgtcaccttcttcattgccggctacacgatcgctctcaccctgggtctcatcttcccttgccaacccatagccaagaactgggacttgaccatcacgaccggtcactgtgtcaaccgcgtcggattctatctcgctacggctattacgaacacagttagcgatgtattattgatcatcatccccatcccagtcatagccaagctgaagcttcccctggtccagaagctcggggtcggctgcatgttcggaattggttgtttgtaggtgaccctccgccagacatctccactgtggtcaattgaactctaacaactcattgcatcaaagaaccataataaccagcatcatccggctggcgactctaatgcccctggtaacgtccgatgaccaaacatacgaaatcgccctagccgtcatcttcatgtgcgtatagaacacagaccaataccatgtacatcttgttaacagaatttctagtatcatcgaagccaacttcatcatcatctgtccctgtctcccctatctgaaacagttcctgcgcttccatgcaccctgctggattggtgactccggcagtaatagcagccagtcgcgaccgtcggcttcttccaacaccaactctacaccgtcgagcaacaggcgcaagccggggttgagcgtgttgcaggatgatattgaacaagcacttagtccaccgatggaggcgcattgtgcttgtatggtgggcgcacgacaggggagttctactagtaatgagtcaagagagttgattggggagcgaaagtagtgtttctcctgatattaatgattgacttatcatgtgctgctgatatgaacattttcttttttttagcatgtaaatatgcttgatacgattaggcgactggttagactgtacttacatcggatgtcatattgtgtcagatatgaagatattgtctttttatgcatacaacgaatgtcaagatacgggccactcgtattgttcctccccatatcactaacatccctaaacaaaaaattggacacatcaagtgcaaactggactcgccgtcggcttcaccactgcattagtgggattcgtctgcgagcacccatccaccaaccccagcaagtaatcatcctctgcggccttgaatgctgctccgcagttggggtcactagtagtaaacaatgttagcgttcctcacacatcatatgaacatcatgttttacatgatgttgaatgtaactggaaatttactcacctcgctcccccactagcatcctcgaaatacgagcagatatcatgtgaaaagcaatcctgggtatagacattgcccagtgcgaccccggtacatcctgatccacaacgtccgttgcaggagtaactagatgtttcgtttgctgtgattagctcatctttccgcttctttcattggagttggcttggttatagggaaagaaaggtattaaagaggatggaaaaggaataattcacatactctccatcgccatcactattctcgccataattactgcctacgacgcccacataggtgcaggtttgatcggcactgttggtccaggtggctgttgcggtggcgccgaccttgaggcatgtcacgctgcgtttttggtgggttgcggagggatgggcggttgcggttagagtcagagtcagagttaggagaagggtagagagggagatcattttggatggttgatctctgtgaggagaattttaaaaagtggtaaataatggaaagctgcactttgttttaactgagagaggtatttccaagtaacacacgttactgcaggctctaggatgagtgaggggacgacactatgttaaatatgaagttgcctacggggtacctcctctctagtgaaggaggaagaggaggtagtactaccttaattgacattaacttggtcgggaattaatctgtcattcgtacctgtgattattcttccccttcctataggcaggcgtgatattgtccgctacggagaatgctccgagtagaggtgatcctccgcagtgatgcacatgcatgattcatgcttcgctgctgactagatactaaggattccttcccctctttctgctcggcagaattctcggacattggatgtgaggggataggggctggggggatcctgcagatccacttgagggattgcatcagggcttctaaaatgacgttttgggcagaatgcagggaagatagagtctaggcatggtgctgccgcagtacagtatctaagtgatggtgattacggagaatcagagatcactgtgtacagagagatatgtctgtcttaaaggagaactaaattgccattgatactatggtctggaaacatcttcaaagtctggatgcctgacatgacacctcaacggtcaggtacccactccaatgaaactaaacggggactagtgcaggggccagcatccttcatcttcttcatgaggttccagtctcggttctgcttcttcccctgaaatgtgcaaacaggttataacatttggaaaaatacctgttttcgttctctcggcttgtattgcttgaactaaacactttttcattctccgcaccggcttactccagcggctacgcggagtcgaagattgtggctctccgcatatcacgcacataccgtccttgatatgagccaccacatgatcggtgcatcacacaagtgttgtcctaacggtgttagcattgcttccgacttccacggacagaatcaaatggtatacatacccacataatcatgtctccattgttctgccagtccacggtgaggacatatttatcctgactagcatgccgcatcaatgcctcaatcacgggtttgctgtctgccctgctccatccgtctatctggtacgcatgtgatcccaagtacagattcattcgattgctgggcttgtgcagctgtaccagttgatgacgtccacgcgatgttgcagcctcaggcagcaacctcagcacaaggatccgcatcaaagcgtaacagaacactaagagcaggctgatgtccacaatctggacccaaatctccagtacacgagctatcagtccctgcggtttatcaatcagtttagccaacataatacgctgccctactgggctggtcgctttctccgcggaccacgtcgtgaacataccacggccattagatatggaagacgacggaggtcatccaagtcggagacgaaaaccaataacctgatgagccaattctccggggctcccaaatatcgactctgcatgagcgaatgccatagcacatgattctgaatttcgttcttggtctcctccgctaggtcggcataagcagtcctggtgtcagcaaatgccgttgcgccgccggttccccttgggggcagttgatgcgcacggagaaggctatatcccgctcggcgttggaagtaggagccatctacgtggaagaggcgtgtgccccggagcagctgcgaccgccacgacgttgtcgacaggatccgaccgtcgccgtccacattcccaatgtccatcagctcacctttaggatcgagtcggtttggcactcccggtttcccgaccgcgctatccaccatcggttcgcctaattggcgcgcaaaggcagtgtggcgtgcatcgtcaagtccggtggcacgaaagaccaggatgccatttttagccattgcggcacgaagctgttcgatgacagcgtccgggactggttttgagaaatccacgccctcacactcggcacctaatgtggggtgaaggggacggaaggtcagagttggacagccaatggccgtgatggccgtggtggtcgtcttagttatggttgccatggccaagcaaaggaagcgtagtgtatgccagccgacaagtgaccgtgtggaaacagtatcccacaatgtgcttgcggaggtaggttggagtttggttattgtgtttatgagattccaggagtcgaatatcgcctgttgccaaaggtgcttgaacccatgtgcgccagaataatagcggcggtgatgacacttaagagctaagtaagtacttcctgttcagaacaagctgtgctaaatgcggcagagttgatggtaatagccagaaaggtaaaatgcaataaatcttcaaatcaagcaataaatcgtaaatatatcaaccggccagtggctccatgaaagttgaccgcttcttgggttttttgcttttttcgttctttcttttattaaagcacataattccatgcttgctcctgcaactaccatcttgccgccatcccttgcgcaatacatccgatccttcagattgaggattacggccaaatccagacagaagaaactagaccgccttcactcaaccttgaacagacggagtttcaaagatcttcaagtatttctagtggaggataagcttttgcgaaccaaaactgtgtttactttgacatgtcaccaacatatgtcgcctagtacatgttgttatgaggtacccataactctgggactcagctaagcctttagtacctcatcgtccccctcgaatatgggatactatgtcgtattttcttatattgaacttagtcacggtgactaattctcgaaccagaatggtgacagctggaacacccaacggtttgtctatatgatattcattgtatagattactacgaattacctcgggaacctctccaacgtcatcatcatgtgaccattttacttacctaatccttatcaccccgccgccaaaagaagtccctcgttgttactctcactcatcccattgttcttctcgcctgcagtcatcaattgaaagtcatttctgcaatattctgcatagcggctacctgtggcatttctgttcttttcaagcttctatcaattgacttgtcatcactaaccgaccgttataagtaagtctccacctgtgcttcttccccgcattagcgatctgaccatatatccgccactgggataactgactcgtcttcttgcaactccaggaacgaacaacatggcgcctccgcagatctgtgtgattggttccctgaatattgatttcgtcacctacaccccccgttgccccgatgctggcgaaaccctgacagccaattccctcgccatcagcgccggcgggaaaggtgccaaccaggcagtcgcgtgcggtcgcgcctcctttgtttccaaagacaaccaagatgcatcggtgtatatgatcggagcggtaggagcgtgtgatccttactactcggcgctcctgcgcccaacactggagggttccggagttagcacaacgggaatccaggaaaagacggacagccaaacgggctctgctacgatcatcgtggatgaaggagccggaggagagaatcggatcttgtttgtccccggcgctaactactcgggaatggataatgtagatgcggtcctcgccaccacccggaatatccatctagaacaaggcgtcgtcgtgatgcagggcgagatcccgaggtcgactaccttggagctgatgaagcacttcaacgacccttcctgcccttctcacctggtgtttaatcctgcgccggtcttcacagaaggaatccccctcgctgcacttgccggcacgagtgtgctggccatgaatgagaccgaagctgtcctcatgactcaggcggtcaaggagcatctcacccctgcccagcaggagcaggacctaaagcccgaagagctggcacctttattccacaaacatgctcaggttcagatcgttctaattacacttggagccaagggtgccttttactccacggccactggcaagcagggctttgctcccagcgccgcggtggagaaggttgtagacaccactgccgccggagacacatttgtcggttacttcgctactgcctttgctaagtttgttgccaccggtgctccactggcggaattcgatgctcagattgaaacggccgttcggaaggcgaacgtggccgccgcagggtgtgtccagaggaagggtgcgatgcagagcattccgttcgcttatgagatctagtgcatggcacaatgaaccatccactgatcactcccaccagtcagaggagtattcgctcatgattttaccgaaaccggacttcatgggccattgatcggaaactaatttcgacatgaaatcacgaccgtagcctttcataccatcaatctgctaccgacactgacaaggtagccgcacttgcaaatttgcagcgtctctcaactcaaaatagatcataccatcaccatacattttcacagaagagactacatatacaatactgaaataaaaatcatagactcggctttcctcaaacccggtttaaattgaacgtgatatatgtattgatgaagtagcccattcaagatgtggctaacgttattcggaccgtaatgattcggcctcgaccgtgcacatctacttctcaaccgtcttttccacttcagtggtctgaataggggtctcctccgcatcactgttggcatagttggcttcgtcggtcataaattcgtcgttgttcaggtaactgaagcggtaccagaagaaaatggtctggagagcgagggcaacagcgggggcaccccagatccagatcaagtcgggatcctctgtgactggtagaaggatctctcccagcgcactggacaaagcagtcatgaagaggaagatcgccatgactagacccctcatactcgcgggcgaccgggcatacgccagttcatacgccgtcacgttgcagaaaatttccgagagggcccccaagatggtgtttggcagctgccaccagatgctgatggggctgacttcggaacaggaggaggcatagtagccgcacggcgaggtcttgtatacgcgccactggaccagggcaccgcacagaccggagagtgcggccagggtgaacccgaatgtgatacgagtgattcgcttaaacgggatgttgtaccgatatagcaaggggtagatgaagtaatcgacgattggcacggccacaatgatggtcaaggcattgaagttgctcagaaggtcgttaggggcgccattggtcgtcatcgatgcaccctggtttgtcgagaccgacccgataccgccgtcattgaggttgtagatggggaaatagaagaagatctccgttgccacgagagttctccgcacatcatccaccagcttgtcgctccagtcgacctggatccccttggctgccaggacactcggtttcgccgcatcgaagaagttcttccgccagacctgccacttgttttggcgcaaagcagttatggtgatcttgatcgccttggcgagatctgagttgccactcggcggcgttctgtacgtcttcttataggcggccgccagaaccaccggcaaaatgaagtagatgatcccggccagcaggaaagccagccaataacccacatatttctccgcatatgtggtggccagcatgtagaatgccccgacgttgatcactccatagaagatgagcatcgttcgagtagccgtcatctcgggatccacaatgaccttctccccggtctttaaaaccttggtgtactgcttttgatggcggtattggtccaagactgtgggtgcaatattgggcttgaagataccggcaccgagggccaacagcagcagcccgatgatgaatggcggcgctgcgtgcgccgtgccagcttgcagaactgaaggaattgcgccgatgatctgaatgatgtgggcaataccacaaatagcgactccgacacaaatggcccagtaccgaccgacatatacgtcggcccacctgatattgtgagcactgcacacacatgtgtccgttttggggattttattttggctcaccatccaccgaagatcggaatgacataggcaaggaactggaatagcaagaccaaaccatcactcgcctggagtcccattcccagcgcaccagctgtctcctgcgtccctcgcggaggtgcacccgcaccatttcctcctacaagcagccggtcagcgttgtgtagaccaggggttgttgggtcagaagagcacctttcggaagagggaactcaatgaagttggagaagacggtctgggcgccgtagtaagatgctcgttcggcgaactccaccagacaaagggagtatgcgatgatggggagataggccgggaccttgcgaaggctgctgagctcttcctccgtgggtggcggatactcctcgttctcaagcgcttgagtatctacctcatagatattcttctcgggatcggacttcgtctgtacttcgcctacctcgttggtggcttcactggcgataatggcgtcggcgaccctagtctcgccggttgaggcagctagaacggtcccctattgtcagtccagggtacatcgatatgcattttgtcacacctacccatattgcgttgattgggcgttgagacgccagggaaatatagtgaaagtgattgaactgccagctcctgagtcgactgaaacggctgcacagcttccgacttttatagcatggctgctagcacggtcggacggatctccggcggccgtcaaacaatgggttaagtagccccagacgatgccattgcaggggcgaatgcccggacgggcatatcgcgcaatgtaacaccagtctttgctatcagttgggctacttaggcagagtatttccactagcaggggtccgtgccttaggggatgtctaccagccctagactgtcccactcggcatcgctgattcgaatcaacgcccgatgataacgattcggccgtcctttgcgccatcggaaccgaccaaccagatcgaggtatcgatattaatatcattgccaagtggatggggtcaagataattgggagtgatgccatttgtttggacttcctcccctgctcgacgcatctttgatcatttccctttctgttcgtgtcgggtgaccttatcatatccgaccgttggctggagggttaccccatcactatcgaaatgcgggacgtcaatgacttgcatcgtctgatcggagtgttagatttcaccgttcattttatatgtgagaggctgctcatggtggaagaatggttgatgttaaaaaaacactggctcgcagaggcgtccatactcattgaacctacgaggggtggtcaccacggcccgagaaagcagcctgaggtccagcagactgaaagccaaacagaccagtgatatagatgagcggaagttaatttcccggccaaagctagtctcgtattactagcttccccagaacatcctggctgaagaggaggtggcctcccgtccgtgcaagcatcagctaagaccgccgccgaaaactatctggaagcttggcgccatccagaaattgctggattggccttatctggcagtttattggcaggccagtcttgtctttgtccaacttggcaggggttcgtggtgcgtggggaaagtcagccaggagtcagccaccacggcaaagctttcctcccgctgcatctcatttgcccgtatcacccctccgtcgcatctagtggaggccttaacgctgatggaggattctaagtatgggaagttacattctcaacaatatcaagcatggcatggggtcttggcattctatcgccttatcagacgcatggcccaggctcgcccacaggttcctggcgggattgtgggcctgctagaagggagcttgagggagttcgccttcctcgagtggccttatatgcatcttcagggaacaggagtgagttgcgaccgggtaaatgttggccatacaataattctgatgactgatgagaatgtgtctagaccgtgcagtggttctggttcatattgtgtcatgaatcgtgagctgctagaattaacgtattcaacacacatttccgaggactattctatggccacactcggaccacgaagatcctgcactacgtcgcttctcaaaaggggggccaataacctggatggccgtcggttacggtggcacaaggccaagtgttcccacttggagcgtgccttttctttttttctgctcttccttcagctgtccagacccgggcagttctcgctcgtgatgtcagtgatgttggtataaggataaggatccgtccagatgagatcaaacctgtgatgcatccaatattagtctcgttgactacagcacacctgtgcagctttcttcaaacatagactcaccggtcatccgggtaggtgggcgcatcatcgtcacccagcttctcagcgatcttggtcaactccttgtgctcccagcagatcaagatgttgccgctgccggtgtagtccttcaccaggtccttgacacacttggtgtccttcttcgagcaggacgtatcgacagtgagccccagttcctcggcgagaggaagaaccgtctcgtacgggcggtcgcgtttgccatctgcgagtctgtcaatccctgacgtattggatcccgaaagcaaactcgagaatcgacgcacctgacttgggttgttctgcaatgatatatccaatgtcatagttggaatccgggccgaatacagtcttcaagcagtcggcccgctcaaaacccacagcattgaggccggtgctcccgttgctgggcttctcgccgtggcgaatcaggtagacggtcggctcggccagagcgagcgttgccgtggccaagaggccgaaagacagggacaacttggtgtacattttaagttgattgtattgactgtgcaaaaggttagggagaagaatcgcccacagtctggatatcctgccccttatatatgggtggatatgcaggaccagcaaaaccgcccccacaaggcgaatcttctccgagttacctttccaacaaggttttcccctgagcaacaccacctccccttgctgcgaatggggttcggcacgatttcaccagcaaagcgtgattgggctggatgctactcaagccttgcacgtgggacagtgcactgccggcaatggcctttcatgacttgtggattgtgatccatcagggccactcgccggtcgatcccgctcgctaaaccgtggccgcccaactccggctccctcatgtgctgtcatccccgatccttccaacagttcagaagttgtgatggagcatctaattggttccaaattgcagagagagtagccctatgaccattcatacagttgagttgtctcagtcgcgtgaagaattcagcgcctctctgccggtgaagatgttgactttcccggcacgggtggatcctggatggaacccaattcgcgccggctggcggagctatcgctgactccgtctcgagggaggccctctcgctcgtcccaggctgtcctccctctccatcttcattttggctcccgaacaatcctttgacccgttgcagatgactctcactgaccaacgatcgacccggagatacccggcccacagcgatcgatcgactgatgctaaccccgggtggaccaatgaatgacccacaagtaccataagatcttcgattccgatagtagccagcggtctaccatagcagcatgttgcacagagtcgtcactggatgagtggatatatacatataccgctcttagatcaaactgaatggcccgaagagagcaacctacaggtaaacaatggatcatttcctgatatcatcgagttctgccaagggttgctttgtcagaactcgaaacttgttctttgcatctcgctctaacccgatgggattgactttcatgtggcgggacgtgtcatgtcatatgaaacgccaccaccatcaatggcccgcaagatccggactcttggtgcgagtagcccacaaggctgtattgcatgccaataaatctaacctacctatttcacatatatccattgaccgcctttttctcgacaacttccatgaacctgccaagtacacctgttaactcatctgcacgatgtccaatgacaaaggtatgacgcatacccgagagatgatcggccatgcagagcaacacaatgctgcgcaccgtctgcggatgcaggtctcaccttgattgactgaactctcccgctagatctggcataccccgaggaaagagagtattctagtcttaagcataaatctacctctgctctcctgtggaccctctcaaggggaaatgttgatttcaagggaggaaactgctcaatccttgcgaattcaccagcatagatacaaccctctccatatcatgtccgcgcgttcgaaactctagtagtagcgacaatgagggtcactaactcacatagatgaccccttttagtgaagggccgcgcttaagaagtatctaggtgttgacgacattgggagtaaaacaaaatggttcggagaggaaagtgcggagaaagtggacagccgtagtagataccataattgctaggagcagtagccaatcttgtagcagtgtcaagcatagcataactagtaaaagtaacaagattttgtctagtctacaacataaattgattgagaacatccggctgtaattattaaacattaaattactgtcaaccatctgtctgggtcaatccattactatacactgtgggaggaagctacaccagcgctttaagaacatcacaagcaagccctgttgggttctccagaatgcgtaccacagtctgcccaaacagatgcagagtctgatccgcctgattctgatcccacagctgatccgagacggaaagcgtaagctcaagtattcccttcgagaggggactacaggtcacacggggatgataataaggcaagcgggatacataggtctcatagtccgaccccaccccaggcaggccgctaccagcaaacgcatcggggatgttcacgtagtggatcccggtacccgggtctgtgtctgccggccaggaggtacactgcgccaccagctcgtcatattcgagtgtctcgaaggccatgctgcgggtttgctgctgatgaaccgcatggaggaggcttgacacggtccagtcagcctggagagtcacacggactgggacgtaattgacacaggcacccacaaccgtttcggcctctggcagctccaggtttcggccgttgacgagctgaccgaatacgatgtcgtgagtgccagccatgtgtgccaggcagagggcccaagctgccttggcgacggtggccatcgtggttccagcgggggctggcgggtatgagacctctgtggtgctcgttataaggcttccccgattatgggaaggcggagaccctgatgaagattcagaacgtagataggtcatgctggaacctcggagcaagtcgcgccagaacttgtatgcctgcgaaggaatattatagatgcggctgtgcaggtattccggaaagtccaccttagcgggacttaaagttatcccctgatatgcccgggcgatgtccgtgaacaggcgaggcatgctgatgccgtcatactgagcatgggacaaccgaagggccattgaatcacggttggaccccatgatcaagcgaagctgggtgtgtagtttgccgggagcaacgggtgctgatgaatcctcgcggcaaatggatcctgctatttctactggattcagatcggtcgtcgtgatttccaccggtacagtggcgtcacctaaagttatttgaactgtagactcgtcccaaggaatgaagaccgttcgcagtatggcgtatttgtctacagcagcctgcacagcatgctgaagacgctgacagtcgatcttgccatgaaaatggaaaataaagtacactttgtgtcgcgcctccaagctctctcgctggaaacgggtagttggcaaaatgtgctcaatggaggttaaagccatcttccactcatcagcaatctccttcgcatagtgcagaagggggctgcggctgtgtgctttcctgacaccttcttgatctggccgcaacgtctctcgcaccacaagagccaggttacgcagctgaggttgctcaaagatatccctgaccgttagcttgaggccgtccttgtacagccttgcaattagggccatggctagcactgaatccattcccagctgaaagagatcttgatcgggtgaaacctgccaaggttgtttatgcaggatactggaaatatgatcctgcaagcgcgtctccatgagggttaagacagaggccacccagttgacatcgggagagctataagtaatgagttcctcttgggacatgtcaaggatgtaattgcggagacgctttcgatcaatttttcctgtcgttgatttgggcaggtatgccaatggcagaaacacagaaggcaccatgtatgaaggcaggctctgatacaatgctgttctagcctcttgaactttctttcgaaaggtgtctgaagggggctcccaaatgccggcatgagatggtgatttacaagcatggccgggagagaagatacatgctgcgaggaacggacccatttgttgctcctctttgggttggatgagatcaatcaccgtaagcgatgcagcgaaagcctgctgaacgtgatgttcaacctcacccagctctaaccgctggccgtgtagcttcacctggtcatccatgcgtccgacaaagatgagtgacccgtcagctgcaaaccgaaccaggtccccagttctgtagacccgaatggtaccgggggagcgaatggcctgcaaccaactgggggcctcaatgaaggcttgataggtacgctgaggctcatttaaatagccctggcccacaatgggtccctcaataagtaactctccaatggctccgtcggggacgagctgttcagggtcgtccggacgtacaacccatccagcgctggcatttgggacgccgatgttccgcgcatcacaggtcatatctaacggcctcgtcacgctcgtgatttgcgtgcactctgctgggccatatgcgctcaggagacagactttatcatgccagacttcaatgtccgttgtattgacccgttcgccgccaaggactagcgtttcgaggtaaagaaactcgctaggagtaagctgacgggcgacagttggggtcagtagcatccaattggctcgcatacgattcgcagctaaggccaaatgccccatacgttcgttttccgagggtacacagagacagcctcctgacatcaatgcggccataacatcgatgattgccgcatcccaggaatgggaggcaaactgtagaacacgcgatgtcgggtttaactgtagtcgagtaatgagggtctcccacgcaatggaaagggaagcatgttcaatcacagcccctttgggtgttccagtcgagccagatgtgaatataatgtatgcagcgctgtgtccgtcaacatgaaccatctcggcccgcgaggagttaacatgtcgagtccacaagcggtcatcatcgacttgcaatactcgtgagcacaggatgtttgctttggagcgcgtacttctatttgcaattgccagtgatgcggcagattgcttggcaatcatatgcaatcgggtagttggatgggtggcatccagaagaattaagcatgccccggctttccagactgccagcataaccaccggaacccagcggctcttttcaaggcataccaaaaccgggtcctccggtttaactccatgggcaaggatctctcccgccaatactgatgagagctgatcaatttccccgtaggtaaattcaccatcccaggcacagacggctgatgaggatggttgctctgcacatcgccgattgatggtttcgtatatcaatgtatttgcagcagccggtggggtaggctgcctcgattccatgcgctgtctctgacccatattcagggcatcaatggcaccaatcttggccgtgggccactccaagacctcacacaggactttttgaaacatcaggcacacatcatgggcctgagaagcattgaccatggatgtttggtatgaaaggtgcaaatccatgcggctcgatgctttggaaacagtcaaggccaacgcatactgagggatgtgaagggagcagtcagtcgtcaggttcgccgtgtaggaatacggggatgcatacctctgtctccccatgtccatccatacaaaccaacgataagcaggatccatcagcgtcgtctctacgatctccagtctcaacaatagttatcattgtgttgaagggtgattgtgtactggacatagccgagtgtaatatctgtccaagtgagacgtaggcatgctccatgcaggacatgaagtgaacggtgtacttttgtaaagtggacagtactgatgaatccctagagagttggatttgactgggcagcgtgttgatcattggaccaactatttcatccacatgagggatggggacatgccgcgcggatgtggcatatccaaagcacacgctgtccgttccggtatattgctgcagcacaatggcccaaactacatgcaagatagcggtaaggctcaggcaatgagtctcacacaactgatcaagagacttcggagggcccaagtcaagcgacacgaagtcgactgtcgcctttggctccgacacgtctgtcactgctgctgtagagtcacggaggcgtggaaagaggcagggctgcgcaccctccaggtattttttccagtagctcaatgacatttccgtatctccttttgcccgcagataggtgacgtaatcccgatagtcaggtaatgaagagggtaggttgttgtagtatgctttcacgaggtcttgttcgatgattcgcagtgacactccatctagaagagcatgacttatatgcagttcgatccaaagccgctcatcatactcctggtgaataattagagttggtaaaggaccatacaggtcttgtgtaccaggtctcttttgggtacatgtactgctatggttgccgtcagccgcaattatgacattgtctattgcattgacgagcacgatctggtggaaccctctccctggtatatcaaggaaaacggtccgcagggctccatgtcgcttgactaccgcatgccacgcccttaccaactgctgacagtcaacgttgggcgcatcataacctctaaccacttcaaagcgatagacttgctgatagaggctggagttgcgtgtgttgctgatgagcatgccctgctgtgcatgggagcaggggtagatatcttgtatctgcccttcatatccagccgggatgccgttatttatctcctcgaactggccatcagtgaaggcggcaagagtagaatccactggagccttggggtgccctacttcaggcagcagccgctgcactgggcccagtgatccatcctggctatgtgcttctaaagatctgtccgcctggacaggatgacccttgaatgatgacgccaaccgcgaaattgttcggcaacggaagatatcctggatggatattggaaggccagcctcgttgcactgcgccgctagttgcatactgctaatagaattgccgcctacccgaaagaagctttcatggatgccaagcttctgaggtgagatccgcaaaacacgggaccagattccatgaagcacaatttctagatctgtgttaggctttgttgtggccgtggagcgatagcctatacgatcatggatggacagagaagcaaccgaggttctcagacgagcacgatctgccttgccattggtattgaagggaatctgtgccaccggtacgaacagcgtcgggatcatatagggtgggatacgatcctgcaggagtgcttccgcgtgttgaacattgttgaggaaatttgtggttgttgggagcaggatgtttgatccagacgctggaaagcctgagccagacacgacgatgagggcaacgagggagctagtttcaaaatcgtcaaacttgaccatctcaacaactacctggatggcgcctgggaaacatagcctgacatgatgttccacctcggcgagctcgatccgctgcccatgtaatttgatttgtgaatccttacggcccacgtaaagcacagatccgtcgggattatatcgagcgatatctcctgtgcggtatattcgagtgtggactgattctccgtgaatggagcggagccagtgaggcggtgatgatgaaaatgcaactcttgtgcgccgagggtctttcgcatatccgacaccgacgttcggcccttccaccaggagttctccttcagcaccaattggcaaaagggtgttgatatcatttgggtctactatccaacaggtgccaccaattgggtatccgatattgttcggatcggttcccggccttacgcttgggttgaccgagcacaccatactgcactctgctgggccgtatgcatttatgaggttgactcgagtggcccacacatcgattatactttgctgcaatggctcacccgcagatattaatgtctgtagtgttgggaccgtatcaggtgaaagtaggtgaatcactgatgctggtgcaaccatccaattgatcttcatggtcgccatcgtgaacgctaggcggttatcacggtcaaagggggtgggaacacagacgcagcctcctacaattaacggaagcagttgttccactaagcttgcgtcgaatccgtaactagagaattgaagcacccgagacgatgccagtaagaggagcctatcaaccaaggtccttgcagtggcaacaaaaccgccatgatgaaccaatgcgagcttaggacaaccagtagtcccggatgtagcgatggcatacatgaggttatgagactgtatatgactgtcgactgatagatgttccccatccgacgctttgagatgagccttgctgataggtagtaccttgatattgagctcctgttccaacgaatgagtgaggtgaggaggaccaaggattaacatgacatccaaagtctggcaaatctcccgacggcgatcaacgggatgagaaggctctagcatcactagggcccctccggctttcaggaccgccagttgggcgacaatggtccaacatgacttctcgaagtagagagcaatgaagtggtcgttgcgaacaccacatagctgcagtttcgcagccaggtactccgtgtaggaatccagctcttcataagtgaggcttccgtcccatgcctcaacggctacggcgtctggttgaagctggcattgccgccgtatcatgtcatgcacaaattcttgatcttgatgctttccagtaggaacagtgagcttattccactgttgcagttctgcggagtcactggggttcagcatattgagcgaggcgatgggaacaccgtctggagcatcctgtaactctctgaagacatggccaacttgcgacagaacccgctgcatctgtgcgggtgccagtactcgagggtcgtaaactgctgtcaggccaatggacgtcgaggagggagaggggagctggcagatcagggttaacgcaacattgctaaactgcgtcaattcggccgcactctggtggtttccagcccaagccagctggcgctttggctggtcgggctgaatgactaggagagtctggaagcgacacgcgctggccgccgatggccctagctggcgaatctgctgcagtccaatgtgttcatacttggactgctccgtaaagcgctgctgtagttgccgtaggaaaagtttgatatccagggtgttctggatatgtatgcgtcggggcaatgtaaccagcgtaggtcccaacagtcgatcgattcccggaacaggggcagctcgtccagaggtggtgatcccgaaccctacatcgcttgcgttcaagtagcaactcactgtcaatgcccaagatgcctggaccatggttgcgagggttatctcagattcattccgcgtcgggctaacaaagacttggtcctgcaaaatagcctgtgggtgtggctcgtatgccccgtccggcaaacgtggaaatagtcgagcttctgtcttcgtttccaactcctgtttccaaaaatgacaacacctgtccatggatttaattacatgcgagacaaatacgttgaaaggcacggttgtgtcttggccccgatatgggccgatgtatttctgattgacctcctcgagcaacaggggcagggaccatccatcgtacaatgcgtgatgtatcgagagcaagagacgatcgggtatcgtggatccgggagattgtagaaggactagatgaatcaagggtgtcccaatgcccatggtacgctggaaatgcagtaacccattctcagggtttatgtccgcttgttccgcggtccatgctaacggacctttgactaccacctgaaacagttcgccggtatagtcttgcataattcgcgtgcggaggatagcatgatcggccgctgtcttttgccacgccatttccaagcgttccaaatccacatcggctatcagatcaaaggcttccagcgcttggtaggagcctcctttttgtaccgttgaggctatgagagtctcctggagcggggtacaaggatatatatcctctatctcacttttggtgacgttgcactggtgagtcgccatattaaccagatatgatgcccgccttccgcttcctaccaggctgaaacggtctggagatggaaccggcacacccttgggggagggtacagcgagactcgccatttccgatagcgtcggatgagcgaaaatatctggcacggaaatgatccatccctcacgttgtgccaacccggccaacctcatcgctctaacagactcaccgccaaggtgaaagaaatgactagttctggcgatattctcgggacgtatgcagagtacctcgcaccacatgtgctgccagatgcgctcctcagccgtctctactggcgcacgcgctgaatctgtactgaacggatgatatggcagcagctgttcggtcgtccacccttctaccaactgccgcaaccgatttcgatcggtcttaccggtgggtgtttgaggaacgtgagataccggaaagaagagggtggggaccatgtaagaagggagccttttctgaagctgtgggtggatttcagctattaatcttctgaatggctcatcgagggcgcatatgatgtccattttgttggttaactgttcaccaaaggccaagaatactgcaagctggctcgattggcggggagacgagtgctggaacaggacctcggcaattgcctgactgcctggtgggagtagctcatcgacatggtgctcgacttccgtcaggtcgaccctttgtgcacggattttgacttgcttatccttgcgtccaatgtagcgcagccaacctggccggttaggtacatactgcaccaggtctccagagcagaagaggcggccaggctcagcaggcccgcgaaactcctgcaaccaggctggcggatcgatatatgatgcttgcgtctgttccatttcgtcaaaatagccccgagttaccgctgggccttctatcaggagctcgcccaccgcaacaatgggggtgaggcaatttggactgccagggaccgtgacccagcccgaggcgccaaccatagcaccaataagtcctggcacaaactcgtctgtgggtttcaggtggagagcggcacactgggtggcctctgctgggccatacaagttgatcaagcgtacatgagaggcccagcggtcgaacatcaccgcaggcatcacttcaccacccaggatgagggtttgcaggctgggaaggtcacttggatgtagcgcactccccacggatggagtcaggattgcgaagttgacgtggtatttctggatgactccgggcaaatctgaaagccgtgcagactctgatgggatgcacagacatccgccgtgcatccagggtgtcagaacctcgtagatactcaagtcaaatgcatagctacagaaatgtagtgttcttatttccggggtgacggccaagatagcactgtagtgaaaaatgtcggtagcgcaatttccatgttctaccatgatgcctttgggctttcccgtggtaccggaagtgaagagaataaatgcaaggtcagtagagcgcacaagtggccaagggatgttctttgcgcttcgtggtatggtatccagtgcaatcgtgaggacaggaaccggcaatgcatctgccagccgcgactgatatgtagatgataccaatgccactgagggccgtgcttggtgtattgtctgggtaatgcgagtctgcggtagagatgggtcaatgttgacacatatgcctcctgaccgaagcactgccaacattgtcacaaccgatatgagggagcggtcaaaaaggagaaccacccgtgaaccctgtttcagtccacggttcaacagatgctgccctagctttcccgagagatcattcaattcagcatatgtcaaggttccatcccatgactccacggcccgcctgtcgggtgtggtctccgcctgcgacagtacgagatgatgaagcggatgagggtatgcggctggtaggctgccgttccattgccgcagcgaggtccaatcttggggagttattgtttcgaggcccccgagcctagcgttgtagctagatggcgcacacatctgatccacgatatgggcaaattggctcagcagtcgatctgcgaccgccggcagtacaatttgcggatcgaactgaaagttcacgcgtacggtttgatgtgccgttgatggggtgcacaatataaccagtgcgtagttgagaaacgccgcatgatccgcaaactgatcacgcagtatcatcatgttaggggaggcctggctatgctcgccatgttgaatgaccaactgtgactgaaatccgcaggcaacgctagcttcatcgctgagctctcggatcctttgcagacctgcctgctcaaagggaatcatgcgcatggaatggtcctgagcatcacgcagagcgtccagaagtagactatcacgacaaattcgcgtgcggaatggaacagtggccatagaagggccagttagaaggtttatcccaggaacagaccgcgctcgaccactgacggtgacgccaaagaccacatcctcagaatctgtataatatgataccagcagtgcccatgccagcctcattactgttgaaagggtaacacttggcaggtgcggtggccgtgggagcctgatctccttttccacgctcgctgtagggttgggcacaaatccaggctcgggcaaacctgggaataccgaagtctgaagaccatggaactcggtgcgccagaattcttcaacatccttaggattctgcaagattagagagcgaataaagggtgtgaatttattgaggggtagacgttcattctgatatgccctttgcacctggtcaaagagtcggggcagggagacgccatcgtaaatggcatgatggagagagacacctacgagtgtctgtccctgggccgagctgaggatgctaaagcgagccaatgtggttcccagttccatgttcagttccatatccttcttgcgccattcattgacggtctcatatctgtgccacaaaatcggagctgcggctggcgtcaggaccacctggaaggtaccgtgcgggtgaacgtgaataatccgggtgcggaggatatcattggcagtcactgttgcttgccacgcggtcttcaatttatttatctcaacatcacgtccgagctcaaatagacactgacagacgtacttgccagctttttgactggcaagggccattaacccttcctgaaaggcggtacacggatagatatcacccaagtcattcagcgatagagcacattgctctagagcggatgagatgatatccgattcgtagtcactgggtagaaggctgaagggcggaatctcagaagtctcctcatccatggtcttggttgccaccgctgccagctcactcaatgtaggatgctggaaaatctcactgacactgattcccatattctgtagcctcgccgctgccaccagctccatggctccaacagaatcacccccaagttggaaaaagtgactgtcagcgaatatctcctcaggccgcatttgcaagatgttcgcgaaagccatctgtagccgtctctcttcttcggtgactggagcttgacgaagagaactatggacattagaggcccctagcgtctctcggggaatcagggtagctagttgtcgcagtctgcgtcgatcaacttttccggatttggtcattgggatgccctgcaccttcagaaccaccgaagggaccatccagttcggtagctcatccccaagatgtgaaagagccttatcgatatcacgctgatatacactattgtcatcattatcaaacgatccggctatctcgcacactgtctcggcgttgtctgtaacatctggggagttaatggatataaaggcgaccagtactgcgcgaccaccgggggatttcaagacaacagcttcgacgacaattgcgccagcccaagggaggtagcttcggagtcgagattccacttcgcccaattccagtcgctggccccggatcttgacctgcaagtccttgcgcccgataaatcgtaccgccccgtcctcagtaaattggacaaggtccccggtgcgatataagcgcgaagggttagtcacgtcgatggttcgatattgggatagccactgagtcggagggatgaacggtgaggagactatatcacggtgctctgcatcgtgtagatagcctcgaccgacgacggtcccttctatgacgagctctcctacagcaccgaccgggaccaaccgctgaacattttctgggtcaacgatccagggcgacatagaagtgaatggcttgcccaaacagttcggatcatccgcctgaaccacagtgcaaagtccaatcggcgtgcattcagccggactatatgcgctgatgagggtcgtgtaaccctgccaggtcgtgaaatcataaggcatgattgcctctcctccaaggactaaagttcgaagggtgggtaggctggcaggttctagtaaccgagacaccgtcggggtcataatcgcccaggttaccgcaaggtccgccatggccttgggcaaattattcaaacggtcatgctccgatggaatgcagacgcaggcccccactaccatgggaactataacctcgatgatactgaagtcaaaggcgtaagacgcaaaatgaagagaccgatcgcctggtcgtaggtccaaccgttgagggcaatttttgattgttgcagccagattctcgtgtgtgataacgacgcctttgggctttcccgtcgagccggatgtgaagactgcatatagggcatttcgaggaagtgtgtcacgatattcggaccccaatccacctggcaaatcgtctgtttcagaacacacaccctccactactaccaacaagggacgttcgcatttggatacctttgcgacatgttttggtgtcgtgatcactaaatttgctcccaaggcatcacagatttcgcgcaggcgatatgtcggatgcgacgagtccatcaggcaaaatgcacccccagctttggcgacagctagaaccgataccaacgtccatttgcaccggtcaaaacaaataccgacaaacgcttcaggcccgaccccacgggccataagccttctagctagattcgaggaaagacagtcgagctcccgatagctcaaagcaccatcccaggcccacaccgccaaggcatctggctgctcgatgcatcgagccttgatcaaatcgtgcacacgcacccgcacggcctccgggggagacccattccattcaacgagcttctgcttatctcgggccgtacatagatcgaggcttccgacggactggcctgaagatgcaccacgtagaatctgcgaaaccgacatggctagagtatctgcgagagcggatgcttgccagtcggacatcatatggctccagtatctgatgcagcacgagacggggggccctggagttacttcaactacgaggtcatattcagtcggtccgtaccaggagaccaatcgtatagggtgttgggaatctgctgcagggtctaagctgtcgacaaagctcattgtggtgttgaagagagtaccgctgctattatttagggaatgttgaagttctgcaatggatacttgtcggtgtggtagttcttcgaggaatagattttggacccgtcgaagcacattcatcactctttcgtcagggttcaattccacacaaaacggcagcgtgttgattagtggcccgaccagatcttcgacacccgctaaagggacatctctcattgccgtcaccgaaccataacaggcacagcgagacccagtatatgcgcttagcaccagtgaccaggcaagcttgaacaccgtggccacggtgacttccgtatccttgcagaatgactgcagatggtcagctatcggcgtcagagggagctctacactgcaaagggctgacgaagcggcctcaaacgggccctgctgcaggcggggaaatatacacggctccgtatgagctaggcgaattctccagtaactgagactctccgctgactgggatgcaacgagatactgggtgtagtcggtgtatgacacactgttgggttcagacacgtcgcccgctgcaacatactcagtctcatccagatagcaacgcctcagatctcggataattatccccaaggagatcatgtccacctgaacatgatgaatatcgattgcacagtatagccgattgccggtagcctcatagattcgtaatcggggaatccactgtaggggctgttcagaggctagagtgggattcgtgctgggcatttgttcaggctcctcatacaacacatccacatcctcagggcggaagcgggacactttcagcgtgatttgaagcgccagggagctgtttccggctggagcttccacgaaaaaggtacgtagcatggggtgacggcggcaaacgtgcgcccatgcacggcgcattcgatcgatatctcgtgctgcagggggctcaaggacttcccacactattcgattatggtagtgggctgggtttcgaatgtgtcccaatagaatgccctgctggatggtggagcagttggaaatggattcgatgtgttcttcttcgataccttcccaaaagtcgagcggaagtttggcttcgagagggccatccctcagagggattatcgtgctaacagaagactcgtcggccaacgttgtgttgctcagcttggcaacagtcttgctctccataatctgcgcgactgtcaagcgcaggcctagcttacggctcaaattgaccagcttcatcgcggcgagagaatctcctcccagacgtatgaagctgtgattaatcccgaagtcctgagcatttatccccagtacctcggcgaaaaggccgtgaaggtctcgctccaggcgagtgcttggaggcgctacattattagtcgtcacagactggtaacgctccaactcgccacgagtgtgctgctggatcagttcgcgtaacagacgacggtcggctttgcccgtcaacgtcgatgggaagcgtcgcagaggaatgtagatgccaggaagcatatgggccggtaacaatggttctaatgcttgtgttaaaatcttcatgtcggcgcggaactgatcggaggggacagcaaatagagaggcctcatctgactgcgtcgtttctgattgctctaatgtgtagttgtccgaataaagaaacgcgactagtaacattgtccctgccccatctctcgggacccctgtctctgcaatcactcgggcgggtgcaggacactgttggctgacgttgtattcgacttctcccaaatccaaacgttggccgcggatcttgacttgcgtggccttccggccaacgtactgcaggttgcccctttccgtatagcggaagaggtctccggttttatacatacggatcggttggctcgcatcctgggaaaatcgaaatgaccttctccagtcgggactttgaatgaatgcggcggcagtagcggttggattgtccaggtattcgcgggcgagtccgggactctcaacgatcaactccccaactgtgcccactgccgcgagtttatcatggttgtcgggatcaacgatccagtgacgaacccggggggtaggcgtatactctaaggcatgtgattgctcgctcagctccgtcaggcaattcagtgccgtcccttcactagacgcataaccgaaaaacacttgcagctttcgcacccaggcctccatatccccggcagccaacggctctccgcctagggcaagcgtctgcaaactagatggggggttatcgtggctcagccgtcgcagtactgacggagtcagcacggcccaggtgacttgcatctcctcgatcacggtaggaagattgttcaacctgtcatggtctgaggggatacagagtgtcccgccattactcaaacaccaatatatctcatagatggccatggtgaagctataggtcgcaaattgcagcacacgtgagtcaggtcccactgacgctgctacaccatcatgggggagttgggccatcgcacggtggtcgatcacacagcctttgggctgcccggtactgcccgaggtgaaaaggacatatgccggagcgtctgcagtcggagttatgtacgccgtcgacaggagtgcggtacgcactgtattcatgatgttctcgttaatcgggatgacttgctcaaccagctgttgagcccgagcgcaatgcgcctcggacgccacaatcaagaaggctttcacacagcgcactatatatcgcaatctctcctgtggatgcgatggctccaggggtacaaaggctgctccggctttgaggacggccaattgggtgatgatgacccattggctgtggcctagaagcaggggcaccatgacacccgggccaacaccgacacgacgcagatactctgccagacacgtgctgcgtgcctcgagatctccgtaggaaatactgccatcccaagcgacaatagcgagcgcgtcggggctccgctgactatgtcgtcgaatggcgtccaggatggaagagggagtgtcgccctcgccaggccagaaggtacggtggttccacttgtgtaggattggtgcatgttggggactaaagaaatccgtatccctgagtgtctggttgggcttgcgcaggatctctgaggcgacatgagcgacagtatctgcaacatactgagcctgctgtctggataataatgtcgctttcgccaggaaatagagacgaggagcattggcatccacttcttccataaccaagcaagcatccacagcttgctgcaactctcacgatgttagcatccataatcatattctgcaatgcgcccgtcagccacttaccattgctctggctctccattgcctatcactgcacagcttgagtagaaagacaccagtattcacctcccagttccgacctcccgcactgataccggtcgttatttgctgctgtctccagataccttctggggtgtcatgtgaagagatgccagctcgatagaccagcatatccaactcagagcaagctgaagtcatgcttcccgccttgaagcacagcccgtctgactcgacatattggcggagaacaatggcccagatgctacgcaacagcactatcagatcaacttcctttcggatactgctttgcagaagatttgtgaggatgtccggggaaatctcccaggcatggaattctgtgtgaccactagagctcgggggtaccagcgtgggaaatacccccacgggcaggtctcctatacttcccattctttccttttcctccttctcttcgggaaattgtgatttgcttggctgagttgagatgaattgaaggtatagcaaaataaagagagcggaaactttatccggcaggtgcatccacgaattcactaatttaagtccatggcaagcctaactccatgtaccttcttttaaatgtgtacctttgttttttcttgttcctcacccggggcctccgcggatgtggctgatgccgcccatgagaatgtttcgatccagggggagaagtggagtagcattgcatccgttgcgatctcaaagtgtcatcccttgcattccgattcaaccattactgcatgcgtcgcgcatcatagtcgacccttagccgtgctccgcgggggagccagggtttcaccactgtggtgggcgtggcttgcctgaacctggttactcccacgggatgaccgtgtagcctggacggctcatcctttatggcagggtatgaagacaggtaactgcacagtacctggctcagggttgtcttaacggagaatcctgggatctcgtttgcggctggggatagcctctactttgtccgttacttgttccggcatccttgtggaaatattgactggatgtcgattcaacgaggtctgtctgtctggacctgaaggatatttagattgatgttcaatggccagccagataagaccgatcaaacagcattggagttagattgcagtccgctctacttcgcgctcttctatcgttccgcgcggtcggaccaccgaaaagccaagcggcattcctaaatgctgagtcgaagcagcaggatgtgataacggctagtcttggaccgactaagcgtcaatcctgtatccccgagaaagatagataatccgtaagggcatcctatggaacggttgactttcaattcatcattgccttgaccgcctcgacaactgggtctacctggagatagtgaaatcacaccctggagttgtagcaggcatcagagattacgatcggcatcggagtcttgtctccgggttcggatgtctatgaatctgggggctttgtttcaacactgcgcaacttaggctgtagtggagaggttctacaaatgaggcatttgttctgtgcgggtgatccaggggtgaatgagattgtagagcggttttgaagggtacacaaaccgcatgatggcgaaaaaggggagaattcacgcatagacagatccatcgcggacggcacaaagctctggggacaacggtctagaacctgcctgtgctcgttcgaggcagtcgccgggacgggaggggttcacctattgcagcgcactcatgggtatggatttggagtaactcgcacgaggtggctggcccttcaacgccaaaggcttgtttagaggccaaagggaacctgaagccgggacaggtggattgtgggtggagagcgacaatctccatatgacctggggtatgaaccgggcatctgccgttgcggaggtacactttcccaccacagagcaagaaggaggagctcctgcatcagactgacagcattttcttttatgtaatggagggcaaacaccagctccacatacatcccaacagtattcagcccggtgcccatccctgccctttgcgacaaccgtccgacgtcagagtatggggtatcgactcagtggggagaattccaaggccagagaggatggtgatacgaactcccagcgtaaaaatctccacacgaggagaatccgggggatgaataaatggcgcccccgcattggaggtgagcccggcttgcccatagagaaggatatctgttaggtaatagcggggatgggaaggcagcagcatggtccagtttctgctccgaccggcaatcgcggacagtagtagcgtaaaggtgcacgtttcacggaggatgaagtaatgccatctcaacgtaatggtcgatctcagctaagctttgtcaaaagagggtgccctctcaacctggggggaacccgaggcccgaggagaaaccattgcaatttggcaagggcgggcgcagggcaggtgcggtcgtagagacggagctcatgctgggaggggggaaggacactatggtaatatattccacgatggcatgtatctctggacagggagagaaagaacgagacgtttgagcaagtagtcgcgatagattgcaaattgcggagtctgggggagaacagagagagaggccaaagtggagggaacggaaagttgggaactccgggcgggcgggacgcagttctcgcgtcggatccgagctggtcccgaagcaggttagcgcgattcagcagcagttggagtaagcgaagtacttaccttactaggctgtttgtgctgtttgtcgcgggaaggtgcctgcctgaggatgattctccaacaattacaacaacaaacacctccaacgcgaaatggatgcctgactccctgcctgactgccggaagggtttggaaatgccggtcgggatgaaatggtcgcgggtgacgcggaggatttgagacagatcagcagatggaaatactactctatacttacgataggggagatagagagataggtcggcatgttggtcagacccgagagtcacaatagtagtagtatctctcggcccgggtcagccatcaggtcaccatgagtaaaaccgagagctaatgaatttggtggtagagactagagagggagggagggagggaggcgtggtcgggcgggataagataagcgccgggatcagccaagggcctgagagactagactcgaactcgactagttcaggcagccggtctccaacaacccacctccctagtaggtctccgtagtaaatgatgttcggtgctcacacgtccgcccggattcagtgagcgatagcaattggtcatcactcctgataagcctggcagtggtgggagctgacttgccgcattcgtcaggcttctagaagattactaaactccacctcgtcaggaaaaaggttgcgccggtgtttctggtgtttctggtgtttctgatgttgcaggtcagcgtcgcttccaccgttgcctgtctctcgagtcagaacccgaccctcctctccatgttccctccaccccgtgagttgtatgtgtctgccaacctccctcgtgcgtccctgttgttccccatcctcgggacagtgcataaagtcgtacaacgcttatgaatactccccttacatacccacgcatacatcgttcagcccgttcagcctcacggctgacccgggtgcaaataaacttcgcgccggacacgccgaacgtagtaagaggacggcgccgatcgggaacgacggagagggagggcggaggaggagcactactgcaagcgcggccagctgccagggctactgattagtctcattggcctcgagtctgggggaaaatgcaggttaacctgaatagccttttagccttttcagtccggttgggcctgaccaccggttacttggccgcattgggactgagggtcggggtcagtctaaccccaaacgggcaaggtctgcagttccaacgtcaccctggggcttaacccctggtgggcgctagtccttttctggctgcctagacgggctaggcactaatactggaaatgggattggctcaaccgaccaagtggcgggagcttggtccccacgtggagagcagataaactggtaaaccttagcaaccgccactctatctcattaccaaatcgtttccactttttttgtctctttctggtttctccatcgtgtgatggccaccacgaaactggtcaaaatgtcttttctgctcattctcgttggtctgttcttgttgccttcgtttatcagctggaactcggcggcggtgcccggattcatccgatccttcctctggtgttctctcgtttcgcgctctcactcttggtgctctgggcggacggttcagtgcctgcggtgaatctccgtcccgctccattcaaaaccctccctcttccctcttgttcctcgcacttccagactcatcctctctctctctctctcttttcctcctccctccctctccccctccccaactcttcatcccaaggcaaccggtgtgtgacagggcactgtgtgttatacttactctgccctcctccacccaaccgccacttaactaaatacctccgccctcccaccactacctacacctcatctatcacttagctctacataaaaacaaaattatcatcatgggttacggcgacgaaatcgccggcatggacaacaagtcccagaatgtcatggggggtgagaagtacgatggtgacttggtggagaagatgagcgagggcgagcggaacatctacgaggccggtatcgaaaagtacaaccgtctgggatggaagcgcctgacggttgtgctgatcgtcgaggccattgcgctgggtagtttgtccattcccggcagtttcgctacccttggtatggttgccggtgtcatcttgaccgtgggtctgggttttgtcgccatctacaccagttacgtggtcggtcaggtcaagctgaagttccccgacgtcgcccactaccccgaggcgggacggctgatgttcggtcgggttggttacgagattgtctacgtgatgctgggtctgcaattgctcttcctgacgggctcccactgcttgacgggtaccatcgccttcattaacattaccgaaagcggcgtctgctccgtcgtgttcgccgtcgtctccgccatcatcctgctgctcttcgccatccctcccagtttcgctgagatggctattctgggctacgtcgactttgtctccatcatcgccgctatcctgatcaccatgattgccacgggaatcacggcttccgacagcacggcgggtctgtccggggtgaactggtccgcttggcccaaggagggcatcaccttcacggacgccttcattgccgtcaccaacattgtcttcgcctacagtttcgccatgtgccagttctcgttcatggatgagatgcacacccccaaggactacgtcaaatccatctgggcgctgggtctcattgaaatcgtcatctacacgctgacgggtgcgctgatctacgcctttgttggtcaggatgtgcagagccccgccttgctgtccgccgggagcatggtgaagcgtgtggcgtttgggattgcgctgcccgtcatcttcatcagtggttcgatcaacacggtggtgctgggccgcatgatccatgggcgcatcttcaagaactcgaccattcgcttcatcaacaccaagatgggctggatcacctggctggccctgatcaccgtcatcacctgggtggcatttgtgatcgccgaggtcattcccttcttctcggatctgctgtccatctcctcttcgctcttcatctcgggcttcaccttctacttccccgcgctgatgtggttcttgctggtgcgcgagggcaagtggaacacgcccaagaacctgatgctgggggcactgaacctgtgctgcctgattattggtctggtgacgctgggggctggtacctatgccagtgtcgacgacattgtaagaccatcctatcttcaattcatctcgatgattatgatgctaatattcttatttttctagattctcaactaccgcaacggttccgttcgtggtgtgttcacctgcgctgctccggagtagagccttctttgtgattatttcgatggggaggcgaccccgaccggtgcccaccttttttttcttccttgttgtgggaatcggtcggaagtcgctctctccccacccctgcaaataccccccaccccaacttactgcatttgcatttgatgtacatatgactcgatgtttatgatttggatttgtgaatacatttacgagcgccctgttgatacacgagcgggtcttttcctgtcatctttgctctgatatttgttccgcctctgcaccagcactatacctcccatgtgttttgatttggcgatagatcaagaccctctcgcaatagagttctacattcttgattattatcatcatcaaacagataagcctcgtatcatgtagataagccttgtggtggcgttgtcttgcccacgggatcgagtcaaggtcaaggtttgcgcaatgctcggatgacgcggggagggcggaggtccatgccaccgcaggcaacatgcaacgtcacaatcacgatcccccctccatccgaacgaaccggccgagcagagaacgagtggaagaaataagcacgccatcggatcaagttcccgctgaggttgcgttggatggatccagcggggtcccatccccagtgtccacttctttaacgaatgtaggatgtcatgatgtagtggatcgccgctgaggtgagatgggctgataccacgaactattactacttcgctgactgcagtgtgtgatagatcgacatgatgatgatggggacacttgcatctctgctactggataataccatcgtccagtctggctgcatctggtctggtatttgttgttcccaatcatcatgtggtatactactagtagagcacagatatatatactacttgtagtaacagtgaattcactgcactactaccatgaatttcatgtcagtggtgataaccagccatggataattactcccctgctatatacggcgcccagtcaggcttccactatccccagcttggatgatgatggccttcacactgaatcataccatgtcatgtgcatctgccgaccagttgccgaatcagtcaccaccatcatgtgacctgtacatgcactcactgcctgagtcattgtccttaatgcataactaatgcatgaataatgaaagaagttcactcctattcttgttgttcttctacctgaaagactccttttcctctccaccatccacaaccagcaatctatcccaagttagctatacctcttcggtccctatcctcacccccctttgcatgtacttagtgtagccctataccaacaccatcccccgtaacgagtataggtttcgcatgccaatattagatccatcaacttgacatccgatcgacactcactagctgaaaccctgccaatcacttcctcctcggctgccccgtatttccacaactggagctgctatttctatcatccggcatccgcatgtctcactccaacacctccatcaatatgcacgcttcagcttgctgtcggccttataaccccgggctactccgggtgggagttgtcctcttcatgctccttccctcataacagcaattccatctccatatttctccatcactttcaatcccatcgccagcatgaaattcactgtcgccgctgtcgctgccttcgctgctggagcactggctcagaatgtccagatcgcctcccccaaggccggccagacggtccaggcgggacagaaggtgattgttcagattgagcgtcccgtaagtcctgcgtcgttgttactctctcaacaaacccgaatgacatgaaatgcgtcgtttcactaaccaagatgttttgcgaatagactccccccaccaacgtcgaggaaatggccatcgccatcggcctgcagtcctgcgcctcggctacctgctacccggcctcggaagtcctgggccacgtcctgtacaatggcgcgtttgaccccgagtaccacgagtggtacttgccccagtatcagaacttcaccgtgaccattcccgagggcacggcttcgggcaaggcggtgctgggtgttgctcatgcttccctgattggagtaagttgatcgccatttcaaccggtgaacctctgctgatttgcttgtgctctaggcttcgtttgagccctatctccagaccctgagtcagaacatcacgatcgcataggttggtgcagtggaggtataggcgggcttagggggatcgcctgattgagtattgtgtacatagcaactcattgcattaattgaagcaaataatcatttctaatgaacggtacacgcaattcctcccgctgatatagctcgtcgcggatggtggtgatttagcgccaatcacgccatcccttgcatttcgtttgcacgacagatcggcatccagcatcaattcgaattgcattgtccaatggaagacctgattgataacatctcaagtggggtggtggtgtcttgacagaatacataaataaaaagcataccttcgcggtcccgctacaccgtgaataaaccactattatttttacaaccatgaaaggactctcacttctcgccttcgccgctctggcgcaggcgtccatcgactcctttgcagcaattggaaaaccagacacccagaatgtcctacaggaccaccatgtagcccatcactcctccagcagtcgccccaacatcgtattcatcctcgtcgacgaccaagacctgcaaatggactccctccactacaccccacgaatcaaccaccacctcgccaaccagggcgccttctaccgcaatcactttgtcacaacggccttgtgctgtccttcacgcgtgagtctctggacaggcaagcaagcccacaacaccaacgtgactgaaatctatcccccatacggtacccactctacttccaaccgcactgccagaaaactaataatgaacaggaggataccccaaattcgtcgccgaaggccaccacgagaactggcttccgctctggctccaagccgccggctactccacctactacacagggaaactcttcaacgcccacaccgtcgacaactacaacgcccccttcgtgacgggcttcaacgcctccgacttcctcctcgacccgtatacataccagtacctccggcctcactaccaacggaaccaggaccccccaaccagttacgagggccatcataccctcgaaatcctctcccaaaaggccctgggatttctcgacgacgctatctccagcaatgacccattcttcctaaccgtcgccccagtggcaccgcactccaacctcaacatgacagacgagtccgacaccaccacattccgcttctctcctcccatcccactagagaaacataagcatttatttcaggatgctaagatcccccgaacccccaacttcaaccccgaccatcccagcggagtcagctgggtacgatccctgccgcaacaagatgccgagagcgtcgcctacaatgatgagttctaccgcgatagactgcgttcgttgcagggggtggatgaactcgtggaggagatcgtcctccgactagatgatgcgggtatcctggataacacgtatatcttttatacctcggataatgggtaccatattggtcagcatcggttacatcccggtaaggagtgtggattcgatgaggatattcgtgtgccgatgtttgtgcgagggcctggggtgccgaagggcgtggaggtgagcgcggtgacgacgcatattgatctggcgccgacgattctggatattgtcggtggcgaagcagagggagagttggatggagttgcgattccgttgacgagagaggagattcatgctgcggatgcggatgggggcagacatgaacatgttaatgttgagtattggggatgggctgggtttgagggtgcgtttggacgggatggtgagtagtatttattttttccccctgtcttatactactgcttgtgaggaaagatgctaatggagtatgatagagaacggtggaccggctaccttcatcaataacacctacaaggggttgaggctgattagtcccgactttaacctctactactctgtctggtgtagtggggaacacgaactctacgatttgactgtatgccaccctcctaccacctctcctttccgttaactacactgacattatatgtacagacggatccttaccaactgcacaacctctacccaaacctagcagtatccaaaataggatcctactcggccgtcaaaatatccacccgtctcgatgccctccttatggtgcttaaatcgtgcaaaggagatacctgcatccagccgtggcggactctgcatccttacggggatgtgcatagcttgctggatgcattggacaacacgttcgatgggttctatgtccgtcaggtccgggtgcagttcggctggtgcgagcatggatatttgctcgaggccgaagggccgcaggtgccgctggcatatcggcatacgaggtggagtgattgggtttgatgggggtggagtacttgcatgatctcaaaaagcaaaggaaacggcaagagtgatgcctggaaaagtaaaatgcagtggaataaagagtgatttgtaaataccgattcccagatatttgagagtgatatcatagaagatccatattttatgcttttgaagctcacaatcctatctttattctgctgaacatttgtaaatctccgggagcaacgcttacagccgactctccctccctggctcactcaccaacttcaccttctgcaacgcatttccatccttgaaccctctcatcaactcgttcgaccccttctccccagctcccaacttccgccacttgaccagctccagtagctccgattgcacttcctccacgcgatccaccaccaactgtcccaacaccggtaggaatttgaacccatgtccactcccccccgtagctaccatcacccccttcttcccaggcacccgatcaatcacccagtgattatcatacgaatctgtgtaccagcataatcgcgtctgcgaaatcccgatccccgcctctttcaactcgggtaaataccgatccaagaacccctgaatcaccgagacagacttctccggtaacccggacacagacggggccgtccacttggtgatcggggcactgcgcacctgtccatctaactgcacctggggatgcgtgtatttcgttccgcggtatccgatcttcagcaccccccggtcatccagagggaagccgtacaggttgctattctccccgctgcgcacgttccattggaagaccgggaagttggatgccgagaatcgttggcggagtggagaaccctctgggatttggatcatcgccacggatcccgcggtggtttcgcagagcccgtccatctctgggacgagggtaggtgtccatccgccgcaggcgaggatggtcagggcggcggtgtggtgtttgccatctgcggtgcggatcccggttacctcaccattggattcgagcaaaccctcgaagcgaccggcttgtcgatctaagatgagcttgacacctagttgctgcgctaggtgaagtgcgtagcgacatgccttgtctgcgtagacgaatcccccgatcatgtcgaggtacccgcttggttgttgtccgtcgcgcgataggtggaaggggtcgacagcgtagccgtagccatctaccttggctcgggtcgcctcttgcgggttggaggcaaacaggtactgagtgtgtccgaggcctgctttggtcaggttctctactgaagccttttcgaaggggttcaggccggctgcgtcgccgtggtcgccgaaatggtagttgccgcagttgacatagatgcgttccttgctagtcattcccgggggaagagtgcttcccttggcaagagactcgttccatgtctcccatgctttgattgcttcgagcgtgaagttctggtaccatgtttcgtggccgtaggcggcccggatgatcttgttgcagtctacaaattgtcattagtaggggaacatacttttggtgctgtgagaatacctgcagatgctgcatcacagccacggtcaaagtcgtagagcgtctcgtggtagggctgacggtcaaagacggtgacgttgcgataccctctccggaccagatggatggcgctggagaggccgaacacgcccgcgccaacaatggcgatcggggcggtcttgtcgaggggagtagacatggtaaatgtgcggtagatacacagcgaaagttgcacgcttatcagggccaatgcgatttatagtcgaagattggttcagacagtggccgctgccaagctgttgataggataaagttggtcgtgcggagaagggcacccccactctttattgctggtcacactgataacgcggggctgcagtagacacgggatggatggaccttcctggaagcaatggagaggaggaggatgatgccagaaggaagaagatgatgtgttccagagaggggttatctatcatcgccatcgctggcatcgggctggcccgcctgggcttccctttgcggcaatccaaccctgatatgcgttggatttactcctcacggcggaatgatacgaagaacagccagtttgatgccatctcccatcttatctgtatggtggcatcaggatcgataagtgatggtgatgatatgccatgtgatcgttgtcacaacagcgaagatgatagtgaagtgaagcatatatgctcgggctgatcccggtcgtccacccagtggccctctttcgatggaaggaaacccctgggaattgtctgaggtgtatagttgaccaccgtctcattgtagccttcaccaaagccaaccatggacacgcagaaagacgactacaagtcacacgctgtcgcagaagaagcaggcgtcgtagtcggggactctgttcccatcgacgccgcagcagagcggtcagtcgtgcgcaagctggactttcggtacctactataccctcttgcctgctaaagagatgctgatctgcagactgcttcccgtcctctcgctcatgtacttcttcaactcccttgaccgctccaacctggggaatgccaaaacggatggcctcgagaacgatctccacctggtcggaaatcagtataatgtcatcttggctgtcttcaacgtcaccttctgcttatttgatctcccgtccaacttgatgttgaagaaattcagtggaaaggtgatgttaccgttgatgatgataggatggtaggttacccttctagtaagtatgtccaacttcgctaatcatgacaccaggggttccatcacactgctgcaatgtgccgtgttcaacttcgcaggcctgttagtctgccgtttaatcatggggatcttcgaagcaggattcttcggtaagtagaaccccccgttgctcgtctgctttactgaccgcgtcagccggggtgatcttctacctcacgcagttctacaaacgcaacgagattgccttcagactgagcatcttctacggcatggtcaccatcgctggtaagtacccctcgcataatagcgtattcttctaaccactcaggtgccttctctggtctcatctcctttggcgtcttccaaatcaagcaccacctcccaggctggaagtacctattcctcattgaaggcggtgccaccctgatcattgcatcctttgcgctttggtggctccctgccagcggcgctcagtgccattggttcaatgaagccgaagctcgcgcagcccaaatgcgcctcttacgggacggttcagtgcggacgggtgagaagctctcaattaccgaggccttggccgcgctcagtgactggcgcgtgctagcatgggctgtcagctgcttctgctacggcgtcgctcaaacttccgttagtaatttcctgccgcagatggtggccctcctgggatattccaccattaagacgaatctctacacggtggcgccgtactgtgtgggtacagtcgtgctctggatcatttgtctatcatctgatcacttccgggaacgttccatacatctggcaggctcgctgatgattacctttgtcgggtatatcatcttgatcgcggtggacgcgtcagagcaccagggtgtcgcctactttgcctgctttctgctggcagccggggccttcgtgcccagctccgtcttccatagttggcacactaataatgtcaccgacgagtcgcagcgtgctgctactgtgggattcctggtgggcgcggccaactgtgctggcatcccgtccagtctggcattcaaggcagatacagccccgcgatataagccggcgctaatcgtcaactgcgcgtttcttcttttcggagtgctggtgatcctggggatggggacgtatttccgctacgataaccggcgccgcgatcgcgagcagggggtgagactcaccgcggcggacgtgtcgaccaagtcgctggtgggcgggtggaaggatccgaattggcgatggaccgcatgaggtcagatattgcagactattatgttgttgtggccctacagtacggccatatgtaaccatgggtgtgcccgttatggcagaacaagggttttcgacgtcggcgtagtaataaccaataaaccggctgagatgaagtcattcagcggcccgctgtttcaagctagtctcttggccacgataaactctgataagcatctatgctcttcaatcggacgaagaatgatgcttccattgttactggctgcaataagcctcagctcccccgcggagaggatcacccggacgtccgagctgactttggtgtacgaccccaaaaccggacagcttgactacggcgacaggggttgagccaatctatttgtacagcgtgtttcccaacggacgaccgttagggcggctgatgcgccccatgattcgccgggaatgaccttatcggggcttatcctgagctgttcgaaaggctgacaggcaccagggatatgcaagccatagcaaattcaaaagtgacatccatgcttccccctctttctttctcatttcctctatgaaccgaatcggttccatgtctcatcatatcctttcctcatggctgccagcgaatacacgcctctactcgaaccctccacacggccgcaagaccggtcatcgcgatggcgggttctggcattgatctgtttcattgtcctgatccaggacttcgctgagtatctctctcaggcgccccagaccgaaatttggctcgaggtcgtcactcgcaagttctgtcctgtagggcaggatgggccggaatgtcagatggaccgcgtgcagagggaggtagccctcctgcagggctggaaggatacgctggagcaggtcccgggtggggatcattctcttcagttacctggaagctcgactaacacatactaggtatactgtttgcagtcccctatggcgtgctggccgaccggatcggacgtcgaccggtcttgcttctatgcgcggtgggattcacgctgagcgatacgtggaccaaggctgtcggtgagtgcagatactatagattagaacctgctaggtctccataactgatgctgttgattaccgttcaggctggttctccgatcagctcccgctgcgactgatctggcttggtccgatagctcaagtgttgggtggcggcacgcaagtagccacctccattatgtatgtcatactcgctgatctgttcagcgacgaagagcagtaagacacctccattgccctagtggatgtttgcctagctcacagagtctaggatcacggcatttctctacgtatcggccacggtgctcgtcagcgagattctggccaccccgcttagtgccctgctcatgacgaaaaacatctggctaccgtatctactatcaccggctttcaatgctggtggtggcctccttttgttcctcttaccggagacactaccacggaccccacccggccaaccgtcgtcctcggagcaggcaccacaacgacagactttccgggggcgcatcagatctggagttgacgagctgagccggtcaattgctgtgatttggcgacatcgtccggtgcaactatttctggtggtgtttattgcgtatctgggaatgcaggtgatgaaactgcttctgctctttgctgccgaccggtttcattggacaattgcgcaggtgagtgggactagaaataagtaaaaacgatatggccagacctaacatttgtttctaggccagcttcctcatacccgtacgagggtttactagactactcctgcttctcgtaatcctgccaggcatatcgcgctggctcatacagcgacggcgcatgtccccattcaccaagaacactagactggctctgacgagtagcgcttgcatgggcgtaggatgtctgctaattgcgctgtccagccatccggcgggcgcagttttggggctggtcgtgtatgcgctcggttcggcaatgcacctatttgctcggcgcattatcacctcgctcgttgacgcgcatcacatgggtacgctgtatacggcgattgcggtgatgcagggaatcggagtattggtagctgggccaatgatggcgacagcgtatggctggggattggcccagggtggagtgtggacgggggcgccgtttttgctggtgggtggactttatggggcggctgggttggcaatcctcctgggaagttgggagggctgcaaggacgatctggaggatggaagatgcagcgagactattggctaggacagacacatcatcgctactttcacagcacttttagtctagtataaaataagcaattgtggtacctagtttgactgaagcttgacagttttagttcattgttgaagcgctggaccgaccactagagaggcatatcgggagggataaaaatagatccccctatagtaagtagatacgtcctggggatcatcgatgtttaccgattcccagctgttggggggtgatgcgaagattatctgtaactgggaagccatcacaagtggttcgctgtagaatcatatctcatgacgcgagcttttatccacaaggaaagtgcaatatcccgtcgtctctgatggatgctgcgatgaagaggcaattcggagattgtgggcgattgttggtgcctggccactagccctgttcgggttgatttgctgccttgctggcctcacccgctcacctgatcgcacctgatcgatccattccgaataacctcatgaagactctttacctctctcgctccgtctgcatggaatcaagcactccaagattaatcatctctcagcttattcttcatccacccaaatcggcatctgcatacctgtcaagcctttcgtgacgatcatcaagatcatgaaacccaccgccaatcactgccacttgcacggcgcccgatccttggaaatcgccgtggctgtccgacgggcttgatttgccaacgacgcgtctttccccccgggctagcggccactagtctatccatcgaactccatccatggcttccctcggcgaatccagccgccgtttcgcccaagcccggcccccactggtcatcagtcggttcctgtttcaaagctgctattttttgctcctggcctttttctctctctcctgacccaccacacgtccagtccaggctgatttgattcccgacgccgccgccgccgccgctgcctcgcccatcgctctttctcctgaaccgttgcttatccttccactagaccactccgcccttctccttgtccgtccttactacctccaccagcatactctcgtttcaacgctttgtcttgctttctttcatctcagtcgcccaccatgcagttgaagtccatcattctcgctttggctttcagtgccttcgctcaggctgctactattcatggctactccgaaaaggactgcaaggggaccaaccccacagattccagtagctcaaagacagatacgtgtctgaccctggaagcgagcaattccaagtccctcaagggtagccctggtgactacgtccttacggcatttgcggaaacgagttgtaatggcaacggctatgccctgccgcccggcaagtgtatcaacggcgacaagttcacgacctacgaggtatgtgccttgagaaggatttgatacgggttactctggggttgctaacagaaccgaactatctaggtccaattcattcccatcgccaagcgaagcaacgcaacggccctgctggagttgtacgccgactactacgccgaattccccgaggaggccgaggagcttaaacgccagctgaacgaagcgtaggggcagaagatggacgccactgtacaatgaacctgtggaactctgcatagttgaatgcctcgattattctttttgaagtgtttggagtttgggataccatatctgcgacattattactagccccatggcacggatgacaatgcaagctattctcgtttccactggagtcacatggcaggaacactggtgtctacagatgatcggttagattgaaaacctgcattgccatgttgcaggtcggatgggatgcgtttggaatggagccgatccggatggacatcaaatgacttgccgatttctggacttcatgcttctagcaggccatgtatcgtagctcgtcaattacatgaaatggcctggaaaagcgattcggtagaaactggtgaaccggcctaggaattggacccttcagcgccacttcagtgactgcatgtccaaagaagtgaagatggatcaagtcctatgaatgctaggcttggaatgtgtagagcggaatggtggtcttattaatcgtcgagaagacatttaggatctgatcaccatggacgctttggacgagatggtgcagacagcagaataattgtaattggatttactgttagcaagcaccgaccggtctacgatcaacaacaattacaaaacgatcgcataagcggatggactttcatttcaactatcgagaactcattgcttcaatattcattctggtttcagttcggacagagcagccagcaacaaagaaacactatgataatgcaatcttgaagaggattgtctcaacccgccatggagatagcttaaatagatctacctctagcagagcagcgccgaccactcctcttgaggcccagtatactcggccgtcgggtccgccaaccaccacagccgatcgggcgaggtgaggatcatatacgcactgatgatgttcatgcagctgcagtccgtatacttcttctcatacgcctctccgatggccggcacccgctcctgccaggtcatcgcatcgtaaccctggcatctcggacactccttgaagtggagcacgcaatgctggagcaggtcatcgtagcgttgcgggttctggcaccggtctcgcagtgaatagttccctggctgggcactgcgtcccacggccttcaacatgggattcatggcattgagcaccgcatcgccgtacggatccaccccgacaccgggactgttcttgtgcggaggcatcaatttgtccagcaacagcccggtctgataccgcgccatgtaaatctgccaggccaattcgcgccctgccagatgaatagcccacaaggcgccgttgtcgagcgcccacgcccaaacatcaatgcagaaccgtcgcaccatggccgtgctcggcactccttggtgcacgctgacaatggttaacagattgtagtattccttggccatattatcatgtcgatagtcgcagatatcatgcatgacggtggacgcaaacgaaatggcgtcgacttcctcgtccgtgccgacgatctgcgactgttccagctgcgcatgcagggctaatgcacggcccgccgagttgatcagccggtagctgatgctccgccgctcgtcgttggggaatttcagctgttgcgctttggggtgcagcacgtccagatacaccgactgcacgcacatcaaccatgcatccatgatcttgcgatgcgggccgggtccgtggtctcggtggacatgctcgatgtactcgctgacgcgctgggtgcagatgtccaacaccacgggcaattcgccgaggaagtggagataatctgggaagcaggccaacatgccggcactgcagcttccgtgcacgcattcatgacagagtttggtgttgtcggacagacaccaggtaaagccgtagacttgctctgccacggcgtgccagaagggggtgtctgggacgtcgaatgactctctcagggcacgaaggagatactccccacgaggcaggaagcccaaacggctgggagccgctgtggcgaggagctcgggatcaggaaggtccttcagatcccgggtccaggccagacattcatggaagatggcggcccgcatgtgtggatcatagatgcccacggggttgcgagcatcgaacaactgcaagccaatggtgggcttccaggccttgcgaagatcagttacgatcctcatgtcttcggagagctgaccggctaccttctcgaggggagggtagaggtcaggtccgaagagagcagtttgagtggcagtggccattgcgagggcagcgaaaggagaaaggtagagtttttgatggatacaacgaagagattgagtgcttgctgatgattgattacttgtaagagttcaatcttgatggatataagatcaaaggactgtttggaaaaaggggtccttatatacctttcctcgagtcctccggattccaagcaatcccgatgacgtcctaatggcgaaaagcgctttgacaatggatacatattgcttcctgtaccgtgctaagatgggtatacaccatcggctagaagtcctgtgaaggtaggattgagcagacttggatgggttgtcgcacggccctaagaagaacgtacactatcccgttgtggcaatttggatgagtctgaactccaccaggtcgtgcggtactacgaagatggtgcaaagtctacgtccggagggagaaagttcaaggaagtggttgctctttcgtgcgatacgctaaggagctacgcggtcgactcgtactacatccagtgatagcccaagatggttttcatggaagatgaattccacggtctcatggtttcgcgattcagccaatactcgtcaaggaacattaccgcatgaagtcccgcctctcgcaagggtgtctttaacggaggtctgtgaccgctaaagctatcgagaacgtgctatcaggttccctttgccttctcagcggcgggtgcccaggtgccttcgtagatagagggcacacaaaatctgcaagaccacgcgcacaatggggcaggtaggcgaaaatacggtgaatgaatcaacgtcaatcttggatggtatgtagtggcatcccagcgcctgttctcagtgtttttctgctcaacctggcagttctgaaccctacaagacagtccaggttggtgccatgcaggtgccacggaacctgcagcggcacaaccgtggagcagcatgaggagggccgtcatctcacaaagaggtacttgcgggtgttttgccagattttcagagactagaaagtcgacgcctgatgtagatacctactccatcgaggaggactattgcaccaaagagaatcaaggacatatctacttagacgttcatactcgtattgctcaagcaaagttggagatcatgtgtttaattcgtcgttatccggctgacgtattcacccaagcccggtttagagcaatgctattctctctatctctatagagactgttgtaacgacatgaccacctgccaacagccacaggttagaaatcaaacacctcagtgctttgactacacaatctgacatatacgatgcttcttctatccgaaaccatcatgaatcaggacaacgcaagtgcgcagacggatattgaacaagacgtgagtcaggatgacatctgtgcgctgcgtaagggacatattccctgaggattacaatacacacaacacacgatcatcaaaagaacttctgtaaaggggtgttctgtaatgtagagtccttggcggttccttggagcctgtagtgctcatttcccagaataggataagaatagcagatcgcattatcttcatgattcaaactcattcagtgtaccacgcatggtgcgtcgtttgcgtgtcatgttctccgagaaaatcaaaatcagagctcgaagcaggttaataacatagccacagcatataagctgcaatactgctgcagcagagccagattcccttacatgcccgttttgacccgttcactgaccacatgttattcgaactcctgcatctagaacctgtttctgcatcctgtcggggtgtatatctatcaataatgtatttgacaaactcctgtcttccaatggccgtcttgcaatgagcaaatcccgagagtatgtacttctgtcctgcagcacacgctaaagcgtaaaaatagccctcacatcgctgtagaagcggggatcggcattttgcggtgaatatcgacactgtaccgtgaaatgctccatcaattgagatacaggcagttcccagtcagtttcgaacaagataggaactctgagagcacgcaagaaaatcatgtaagtcgaccccaccgatcatcacacgaacaatttgctttgcttattagtggatacagagtacggttccactattacatcctagggccgataaaagttatggagaaggtccgttgaaagtcagattaagaactcgtcattgttttggagatcgttgcctacacctccataccataggcgttaaactgtatgctccacccgtcaagagctggaactgccacgcttgggcctaggaggggtaaccgacgcgccctgcgcatgtaatatccgtccgagatgcaactgggccctgagtggcccctaatcccattcccgggtcttgaaggaatgcagccacggggagcacagtcacatgcatatacgcatgaaaagtaacatgtttgattagagcgatccttattccgtgctccacgtcacggggttattgagtcttgatatcttgatattatccgagtgagactcggcggcaaggctcgaggttgtgtcatgcccgcctcgtcgtactctggttggcttcaaggaccatcaatcctgataagaaagcgaagacaggaaaaccaatggcttgaactacacttgtgttgtacgaatctaccggttgacgtcacatggatcaggcagccctcttccccatacactacaaggctatcggatacgcaaggagtagaagcaaggtggatatctggtatgcttgtaccgctctgtccatctgcgtacgtctattttcggccgaacaaatcacgtgaaatgcgtttggaggtagttactctgtagtggcatatgcaagcagctagggacccgaggaaacgctgaaacagatgttgttggaacgaaaaggtcagggaaaccggaatacattgtagagcatcgctgtatacaccacgtcgcgccgcatcgcatcacagttccaccatggccaacgttcagaaattagtgtgcacggatcgcttcggtaccagaaagctggactcagtgggcaggtgaagatccaaaccttcccgagccatgaaagatcagcatctccactttgggaagatcacaggggatggcgccaatgacgcttaccagtcaggcctcctcccttgcgggatgtgctgaacggctgaccccttggcgcatacgtcttctgcccatgggcgcatcctggaccatgtcttcaaccgctgaattgctctggaagatacgaccgatggcagccagacccaccaagagagtgagcggcaatatggtgatagtgcacagagatggctcgccagaagcggcacacgaagccaggcacactgtgctcgccaaaactgccgagaagctcatgatgagggctgtgctagtggaaattggggtaccaacgtttagagagtggaaagggaagtaaaagctcggggtccgtgtcaataaaaatcagatttgcaactacggaggcagaagggaaaggatgaggctagatttataatgaacttctttgcagatgatgtgatggacattacggctattttatcctctctatcgaccatgttggacgtcagcataaatacaacagtcaaaaggcagtaaagttaaattgcaacatggtccttttgaagacttcgttcgtactttatcacatccggttttggaacaaagttctgttggtgcattggacatgccttaacgggaaattttccaaagttagtacctctgctgaacgaagaattccttgaacctgcaagacaacgatggatgacaaatagcagacccacgaggcaccgcctgcattgaatcctgcagggctggaaaggcggaagatggcaagatgcatagaggaagcatactcgctcagctggctacccaaccaccgtggaggactgttccagccaggatatggacataatcaagttgtccggctcaaacaaaatcgctcatgacttccagctcctaaaacctaaaatgtacgatttgcgcactttgatgattcttgacgtcggagaattatagacagtttccggtcagttgggatgaggatgggcacttatgcgcgcctggcggagtttgtagagcatggaccccattcggacatttagagaatgctttggtcatttcaggtgtactcttcgtattctaagttattctactctgatagatctagatgtttggtctgcagaacttatattattttaaatgcctctggaaccctcatggcctactagctgttggattcatcatactgcatcaatcatccacgttccctgttggtggcaatcccatagcaaggcattaagaaatccgcaagaccttgatgaaagcacatatctgacgcaggcagcttctagaacacaatacgtgcgccttacgcagtcaatgcacaggctcataatcagggtttggaatacggagtggtggggaaattgtatctggggatgatggtgacgttcattggtggcttaacgtgtgattatattcagattaggctcagaataattctcacgacgctcaatctggaagtacctggtgtcctcggtgtgaagagagaaagggtagtatgacagtgtatctaaatatctatcatggtctattcgaacttctaccaaatgcaaatgtctatagcgaacgtctaagcagttagtcggaagagaaacccccgttaaatgcataccccattacaggccctgcctcagtcataaccgtagcacaggtaacctccctgggtgttcatcacctcggcaatagtgatgttaggcatgatgttgaacgaggagagttcgtagtgaagggtagcgttctgccaacctccagctggttccacgttggccgtgtgattcagagtcggaccgctgatgtcgtacaaccggttgatgggatcttgctgctgccacttccaccaaacccgatcaatgtacatgtggtgcatgaagaagatcgggtcgccgggcgagctcttgatatctgccatctgtgcatttcgtcagtcagtatcctgcatacggctggattcttactaggaagtgtcacataccacaccaccaatgtaggtgtgtacacccttgtggggaatgttggagatgcaattccaccatggagcataggtgttgtaagcattacacatctctagcacggtgctgttggcgttggcaatcgccttctcggtgttccatgcgcggcgcaagcagtagtccgtgtcttcatcacccggcccaatgtgcaaagtgaggttggaaaaccgaccatcgcgcacacagttgtcggacccggtaccattgcctccaaaggcatcggctccccacatcgatgattgccacatgttgccgctatcggcatccttttgctcatcccaccagctagaacgatctctgttagtctcctgggctaagagaatgccccacagggaaatgggaaaaattgcttacggaataggaccgtcgtatccacactcgttacgaagcagggcctcgtagatgtgcatgtagtagcggtgccaggggaggaattgtccctgaccaggctgttagtgaaacaataggcttatcgcgagccattcaggttgacctaccacatggtggatgatatccgcatacgccgtgttggtcattccacggtgaagggcctggaggtcactaaaccgactggtcgttgctgtcagaccggattcggctggcttgttcatcaagcattgaaccgagtccagaaaactgttctgctcgtgcgtggtcaagtggcgccattccttgcggacagtcatcttctcgcgagtgcagttgcggctgaagaatccgggaatatcatacgaagtggtctccgtgtggtcagttttcatagatgaatgggggactgcagcagcagaggtagtggctgccagagccaatgctaccaggaacgaagggaacttcatcctgtgaagtggagtagaggaaaggtttcaaaagatagaattataagatggagagagcgtgtgatgcagagaaagagaaaagatgctaatgaatgtgaaaaatagggtgatacttgaaagaaaagaaatagagaatgaatgacaacctaaagaaaggagacttcgacatcacagctgtgatccatgggctttatacttctcatcgttggaaaccgagagacccgacaaacattaagggaaccttcaaaaacatcctttcattctgcgatcggcatttaagggtatgaattgggaaaggtctcgaagatttgttccataaggctggcaaagccggtgacatgggaatggaggagcatacgtcgaacggtccacatcagtgatgatagcggattgtatttcaggaagccaaggtttcagccacacccagaccaaaacatattgacttccttctgactcggctcctggcgtcttttagcgacaacgaagggcacaggttgttgagacgggcgagcacataatcctggacactacataatggtaacacggatacaagatgatcagtcaagtggacgcttaccacaagcatcgaatttacgcacgctctacagagaactttgaagaacaggggaggatgggaaaggatactctatagttggagacattcatcagacacgagtggatgtggagcaacgctattgactattcacggattgcctccggcacgtacggaaggcaggcaccttagatggacccaatgccggtgaagggatcttgctcggtggcagtcaaacgcgcagttctcactacgctgaccgagagttgcggttatgcaatattccgacaaacagcgctgcacatgggaatagcttcagcaagtgagccattcgtaaggcgccccgtcgggaatacgtagggcaggcttggcacgccccaggcgagggccattgacgcgcgtcggcactcagccggtcaagcttcgcctggcgaaaagctagaaaaagctaatcgccagtagagcgatagggactagatagtagatacagtggtggatcaaccaaggggtcactgtcactgtcactgtcaagcagcagattatctcgattctcgatggcagccgaccaatttgccgacccactctggcccaccgatagaaaacggcaacgatcgactcagaaggtttgtagtgctccagttctatttattcccttgttgagtcttgactcgagaacagaatgaaagatgcttgtagcgcaggtttatctagggagagcgggatgcatggcagcaaactctgcggcggaagctgaactgctggtggaaccgcactttcaatgctagggctccgccgaacaaaatcttctcattgttgatgaagccaagatcttatcttgaaaaactgcccaattttttagacacgggcatgttaagatgattaggtcagcggctccaatgcgccaatcgcatcccttgcttcagagacggggttcttcgttgaccagagcaaacagtcagtgtgggtcggcatccatactatcgatgacccaggagtccaggaccaacccggtgggctgcaggtgaaaccttcggttccgcagagatgtaaatacacttgcaagcgatggcaaaagtcagtgggggcataggctgtatatcgaaggtccggttagcagagtggcaatgaaccgccctgagagcagagatttcaaaagctgcttaatagtgagcaatttcttagccttcatctctcatattgggaagcaggtatttaaacgggttgtcacacaatcgatcctttatgtcctccggggtatttagtatgtatgtgcgagtgatgcattcacactgcgagatcattcatcatgaggcgtataagcttctcttggcacgaaaggaccggcctagagccacgtgaattctatgcaagccatccaaacacgttgtaggccggttgttttagaatggcagtccgatccacctgaatacgagaaggcctgtgatccgtcagctgtccttccacaaatgcgttgggaggctttttgtatcctacccctgagtaagcgagctcatgagtactcctctttatcagggcgcaatacggatttcgataaaaaaatgttggtttagtagcaggcagtgccggctactttccagagatgggagttacttttgccttacctcctccttttcctgaaggtcccttcagggatggcgtattttggcttgctgcctttcgttctccatttttggttgtcaggaatcacaattaagatgtgagtgcctaccacctacgagtgataagactggggacaagtctcaggcaagaggttggctgaagacttggtcattgtcgatggctcagcgcaatcaacccgtgggcatgcaaaatgggcgatgagattgataataacagtgatcatgtcaacagcacaataacaaacaagcctttgcctaggacttggcgtaatttatcacgggtccctacatgccgttgccttgaactgacatgatcttctttatcagaaaccagccaggggaacaatgacttattgccttataagccggttcatgataaggcagaccagaacatgctgaaatgtgtcgatagtcgaaacttcaacaaatagaccttcgcgtctcgctgccatggactgtttgcacctagatgtaaacggtgatcgccagaccggcaagctgccaccctcttctagcaacgattgacgtcgggtcgatcttcggtaccggtgacttcaatctatacctggcaatacacatcgtggaccttgtgggtcgatccggtgcctatcctactgatgccgctcatgttagcatctcaaaagcagtatgaaccgtacagtcgaatcgaacctgatctgcggcaactccacacaactcagcggtctctccacgtgttctgggcagaatcgctgtcttctcccggccattcatcccaccgcaagactgagctagatgcaatgctagatgcaatggcccgttctgggtgcttaaagattacaaagttcgtccacatgtccaaatgattggactgatacggcctagccacaacatactcatctgatttctgtctatcggtgcataagcagtcaaaagaacctcgcacgggaagttgccaagtcgtggagacggcgcccccagtcgtgtgcttcgagtcaccctcaataatcaaggaccacgaacaattcaggcttgcgggatttctgttttggaagatcatgagcgaacccgaccttccaatggtatagggcccctgattccatccaactgagctgatgtcgaatgtgcgcgggcatctgttccccatttgggcagatatccgcttagccgttgtgaatgatccccgaattctccggtcttggaaccatatgccctctgcaatgaaaatatcaaagccggacagcggtaacaatgataagagatgcagcatgaattaatccgccgtgatggtgacgaggcggcgtcatccatgctttgaagcggggctgaagatgttggcgccggggatgcagtggatatcccgacggactccggcccgttgccttttagccacgcctgacccctcatgccggtagttacgcctcttcaggggatgtaattcagactgctaacgcgtttttcacctggggacagactgaggtgcgtgaaataagtggcatttttcgcataaaagcagtgttctactgctccccaatatccaacatttgacgtccagcccaagtccttacagtggaccaaaacccacttcccttggtgtttgattgcatctcgttgccgatagacaagtggatggtgtgaaggctaatttaattgatttctccggagtttgcaggttcggcaaggcacgagccattcaatgacccccattcttcatcctaaatgaagtttatctgccacacacgggacgatccccgcagagccaatagattgtttctctcgttatcatcacgccatgaccacacgtcgtcaccgttgaggatgatagtctgatggccattccgcttgaggcaaagtgtgccccaatgtcacgcggtcagctagtcttctgcaggtctgcagttggacaggggaacttgagtgctattatcgccaaggtgaatgttctctaccgctttgataccagagtgatcgtcccttttgccgtcactcttggtgttgcgaagcagatgtcgttcgtttgcatatgggagccgaagatccacgcagggtgcttgaaaagacatactgcgatcctcccgtttccaagaatgcttgtacacttgaagtttttgtcaagatccccccgcctggccagtcccgagctaagcgaaatgagctttccctcaatgctgcagacaggagacaccatcgctttggcgccttggcaccatcagccaccgtcggtcctatcatcatcgccctggtcaatagggaacgcgtcaattgcgtatctgggtagtgttatctgctcgatattgcaccggcagagcaggaatcgggattggcggatgtagagaaaattcagcttcaaggaggggggaagggagacgctgaaatggtataaaaccacgtccaattccctaccagatagccctcatccagcagcatcaaaagcatcttccactcagactccaagcagctcccagtccctcttcaattcattaccttccaaacatcatcccatcaagatgaagactactgctctcttgaccgccggcctgctggccaccactgctatggccgctcctctgacggccaagcgccaggctgctcgggccaagcgctccacgaaccgccagagcaaccctcccttcaagcctggcaccaacgaggtcctcgcccttaacggcaccaagaatgtggagtacagctccaactgggccggtgccgtcctcattggcactggttacactgccgtgaccgccgagttcgtcgtgcccaccccctccgtgccctccggtggctcgagccgcgaggagtactgtgcctccgcctgggtgggcattgacggtgacacctgtgacactgctatcctccagaccggtgtggacttttgtgtccagggcagcgaggtgagcttcgatgcctggtacgagtggtaccccgactacgcctacgacttcagcggcatctccatctcggccggtgataccatcaaggtcaccgtcgatgccagcagcgacaccaccggtactgccacgattgagaacgtgagcactggtaccacggtcacccacagcttcacgggcggtgttgatggtgatctgtgtgagtacaacgctgagtggatcgtcgaggacttcgaggaggatgactccctcgttccctttgccgactttggcaccgtgactttcaccagctgctccgctaccaaggatggttcctctgttggccctgaggatgctaccatcatcgacatcgagcagaatgaggtgctgacctccgtttccgtctccagtagcgaggtcgttgtcaagtacgtctaagacgttggatgtatggggttcgggattgttgatgccccgatgggtgtgctttcgacggcaatggtgagatgagtgatggaaatgagaggttggtcttttggcccggggctagttttctcttggtactcctgaaaagccaatagttcaaatgtctttatcttgttagtttgatgttatagtttgccttgagttgatttaattgaaccaacgttggatcatcgtatcccttagcgcaaataaaatattacgtacgccttttaaaatattatgtatgtctgttaaggttctgactgttcagatttatgtcaaacaacagcaaatcattggtaatccaggactcggggatatgagcttcagacattcaccccattactgcatgactatgaccgtgtctttagcaatccaataatgccgcttacacaacgaatatatatcactaacatctggctgcgtggggcagaggcaaattgacttttacaatgcatttaggatacaaaatatagtacaattcgatgctattactagcactgatttgagatgtctgtcggggccagtaatacctttcaaacaccaaatctaaactcgcgcaccttcttctggtagtagaaagatgccaacagacccgtcgcacccagagccaaggggatcggagccctagcgcgggtcttgatagagcgcatgacaccggagacgaggaggaccacactgtttcccagggccaattccgtgccgtagtccttgttctccttgatcaaatagcctgcaagcttgttgtcagttaatattctctaagttgtatggaattgctacgtacctgcataggcgtaggaaagacccaggccgacacctgcgatcagggacggggcggaacgcgtccgcatgtagccggcgatgccacccaccggcactgttgggttattgattgtttagcctatgtctggtcattcatgcatttagagaggtgtgagcttacgcaggcaagccagagtaaaagaggggtgttcagccatggttttcgatgctggaataaattgaggagatggatgaaggaatagtagtaactctaaagatgaatctccatgttgtgtccttctcggcattccggatgctcggagggcgaatagcccgagcacgagcagccaatcagatgcggtagaaatacgtgacacaggctggcatacagtaattatatgttgttatactggcttgactggattgattctgagaggaaatggtgaattccttgtttactattgctgtatagtctggaatgccggtgtatatctccggtgtaatgttgaagaatttatgctgatcatacggagtgtcatgggtgcaaaataaacgatatacatgatgagttcaactactgcgtgatacgaaataaccgtgtttcaactcctctcaaaagtactgatagaagagacaactcactcattcagatgtagtctcaatgattacgagtgactctacccttcaggaaagctttcatcttaaacaattgaataactgtgattactaccaacttcatttgattcccttagtaactcagttgcccgtatccggatagaggcacgtgattttagtcatcacctaagacggagtccggctctccgcctgcctgattagaaaggcaggcacaaatcctcaccgcccggtccatgatgggtgcctggggctctgccgaagtgtcatcgtccatggctccttacatctctgttgacttgatttgtctagtatctacatacagcaatacgcatcgcccctctttcaaacccccttgtcatataacctcccgcccgatgccaaatccagcgccactgcctcctgcaatcccaccacattgaacaagtcccgcggacttacccccggttgcacagcctgcgtgcccgtttccttcaactgctgtaccgccccacgaaccgccgagtagactgctcccaatgccaacccagggaagatgatcagccggaatccgagctcctgcgcctgctgaaccgagagatctggggatacacccccaggaacgttattgaagagaacgggggtgggcttgagctcttcacagacctgtcgagcttggtccgtcgacgtgatgccttctaggaaggccacgtctgcccccagggcgatggctcccttgagtcgggaaatggccgcctcatagcctagcgactggagggcatccgtccgagctatcagaacaatatcgccatgggaccgggcgcgagcattcacggcggcttggatgcggtccaaatactcgtcctcggggacgagctgcttgttgcgcaagtgaccgcagcgtttgctggtgggctggtcttccaggtgcagggcggcgactccggcgcggatgtattcggtgacagtgcggtggaccatgagggatcctagtagtagtgtgtgcctggtcagccactggattctgtcattggtggcggaacagtacctccgaagcccgtgtcagcgtcagcaatcaacggcactgtcgggtccaggttggcgatcatttcagcattccctcgcatttcgttcagcgtgacaacccccaggtccggttgccccagtcgcgaggccgtggtgcctgctcctgtctgacaaccagtgtgagcagagggatagaaccccaactagcagtaattggtgtagtgcctaccatgtacaatgcatcgaacccttcctgcagggcgattcgggcggtaaagccatcgtagacgcccggacagacgataatcttgctctcatcctccaagagctggcgaagcttggtaaccgcaggagcagtggccattgtaatgtatgcagtgaatcaattggggcgtagttcgggcacaattgaggggttgcagccagcagtgctcgatggagccatatgatgatgttatatctcacttgtaaatcctccgggccgcaagcgggccgagtccggcaatgcaggatgcaaggctgtatcccactacatatattaagacacggtcgtaagcttgcttgagaaaccccgctcagagaagctcgctcactaagcctcttcagcatcacattctcatcatgggtgacgccagcgaaccatatgccccttcgctgctgctggtattgcagcaaacccgggatgtcgtcctctccgaggcagacagtacgtctggaacaccaaagaatcacacggcgatggattcactaacgtggcgaagcatacgcattgccgaccctaggaaatctgcttacccagctggtgcgagtggtcgatgcacttcgagcgcaggaccacccccgggaggccaatgccctcaccgatgtcctcgcgatcagccaacaacccacggagatgggaggactcggtctatccgaagcggacactctgacacccgagcaggaagctgaaatcaccttcctggtgacggcgtggctcgaagctttgaactcagccgatcgcgccagggcaccgcccgttccgctcgcggtccgaccccccggtcgacgtggcatgacgctgagtgagaagatctttgcgcttcacgatcttggtcgcaagggatccgtggcgcctggggagttgatccgggtggacgtcgactgggttattgcttccgaggcatcatggcaggtacgcattctcattcgacgtatagctacatatccagatggttactgaaaatttcgtagggcatggaacaaacgtatgagcgtctcgggaaacctggaatctatcggaatgaccggttctggctggcgggagatcatgttgtggaccctcgcgtgaatgaggtccccaaagttaaggcattgattgacgctagtgagagggccaagcgtgtcttcaaaatgaccgactatcagggcatgaacgtacgtccgttgcagaattgcgagactgcatagcctgtactcactcactgtagtatactattcttcataccgagttctaccgcgagcgagcccagccgggtatggtggtcgtgggttccgattcccacacctgctcgtccggagcattaggctgcctggccattgggttgggcgcagccgatgtgacccttccattggtcaccggagagacctggttcaaagtgcccgaatcggtcaacattcgtctcgtcggtgctcccaagcccggaattggaggcaaggacacgatcttgtacatcctgcaacaactgaagcgaaacaccgtggccgcagaccggattgtcgagttcaccggcccaggtgtgaaacatctttcatgcgatgctcggtttgccattagcaacatgactacagtctgtctataatatcatatgaaggcgaaaatgtactaacgatcataggaattcggcggaattaccggtgtctttgtgcccgatcaaattacagaagaattcatccagaagcgacgtctgccccgacacaaaaccgccagcgtctacttcaaacccgatgatgacgccgagtacgccgaaacccatgaaatagaccttggcgaggtgcgatctttcctggccaaataccccaaccctgacgacgtcgttccggtcactgagcaggaaggcatgcacctggatggatgctttattggtgcctgcaccactgccgaggaggatctgattctcggtgctctcgtgctggaacaagggctccagaatggcttgaagccagtttctcacggaaagaggaaggttgttccgggctcagtgcccatccttcatagactccgtgagcttgggcttgcgcagatctacgaggatgctggatttgagatcggcattccaggatgcagctactgtgtcggaatgtcggctgatcaggctggacctggagaagtctggatatcttcccagaaccgcaactttgagaaccgtatgggcaaaggtaggtcgctaaccctgttggcgaagatagcggcacatgtctaacggcactacaaggctccatcggaaatcttgcatcagctgccacagttgcggcatcgtctttcgagatgaagctgaaagatccacatgaatacctcgcagccatcgatctcgaaagatggcataccctccgcggtgtttctgtgtctgcaacagactccacacaagaacacatctcttatatggaacctagtggctccgcgactgcggaggcaaagactgttgactcaccagacgtcaaggtaacagaggcaaatactccagagacagcagatagctcttcgtccgacctcatgacaggcaaagtgcagcgactgggcgattttattgataccgatgctgtatgctgatccctccacccttgcgcctgaaacggcagctaattagtaccagttggcccctgcccagtttctcatcggcatgtcaaacaatcagatcgcaggcgagcactgcctcgagcacacccaccccgagtttcggcagcgcgtgaaagacggcttcaatatcgtcgtggcaggcaaggcattcggatgtggatcgtcccgcgaacaagcggtcatggcgctgttaggtacacctatcccaccctctcatagtcaattccgtgttaacaaaggcataatctaggctgcggcgtccaatgtgtgattgccaagtcatactcatttatcttccagcgcaacatgcccagtcttggtcttttgggcatcacactgaccgacgaggagttttacgacgcggctcaagacggcaacgagatttccatagacttcaagaccaaggtgatcaacgtggatgggaagcaatacgctttccagttgagtcagatggagcgggaactctttcagcatggcggtattgcgtcggccttccagaaatttggaaaccggctgttcgagcagatgaccagaccgaagaatctggggggtgccaagtcccttgcgctgcgtggaagtggggagagtgctggtccgcatgcaggtttgcagtggtagtagcctacttagtatcgtgaagatagtcttcagtaaaacaagacgtagctttactattatgatattcgttatgcatgatcgaactgcttttgatagacagaaatcagtaaatgaaagcagtggcacaccacgtagctgtgtcaacaccctccaggagcagtgaatatttccccatccaagctgaaaggcaacaaagcaagcaactctgcatcgacaacatcctccagcgtcaagccatccggacaagcatcttctatcccaaccggaaaactagtagcagcctcctgacccgccgagcctgtcccccgtgcgcttagtcccccgcgctgctgctccatagccctattatcggcgaaatatccccgactcgcgagaggtgtattcgttccactacggggctgtccaccaaactgctccctccacatccatatggaatcatggactaaactggcagctaagcgtgttttcagccgtaaaccaggcggcttgtcccgctgcccacgatgaacgacttgagcactccataactgggtgagaatcttcgacattcgccccggcagatcgttatcctcgatagatgttcggcgggtaagagcaatggcggagttgaatgagcgcttaccggtctctaggtctacaaacgggccaagattcgagtaactcaacttcatgatgaacatggctgcgatggagatgatgcggaaataggacacgggcccgtaggccatggcgtcggtgagggcttcgagttggttgatgatggttatggtggagatggctatgctgtaggcgcgcaggagcccgcgtttgcgcgtgtcggagtcggattcctcgagtaggtagaagacgtagagttgcaggccaatgccgttgagtaggactttattttcttctgcaagcaggggttagtaatgatggcatgggtgaactggtgtctgtgggggggtgtgacggaccagatatgtagctggttaaactggatgccagctcagtgtattctcgctctagcagggccagcaaggagatgaactcccccggacgaggaagatccgttggcccttgcgaatggctggacatgaattgaccgacgcgggccgagaaacgcgataaaaggagttgatgcttgagggacatggggatcatcgtgctgtcccggtcacagagccgatcgatcatccagtctgacgagacccatacttgtccgtctatggttacgattctgttagggatatttaggttagatggctacgataaattatggatacagctggacgtcacctacgtttgagcggtgatatagcaggtcgcccatgttcgcgctacttcggccatctcatccggcatcaaacgtcttttggttcgcgagaaatcttggatggcttccgggcgatgcaacccgatgcggagggatattgtctgcgcagtggataggaggatggaagtaatatcggacgaaagagatgaagtgggaaatggccacagacaaactaggataatagcctgcacgacatgccaggtgtgcggggggttggcgatggtatcccatatgagcttcttgaccggagccgtgagactgacaaacaagcctggttcttccgtatatcgacgagaggctagcaggatgatggaccagaataacactgcagaccgagcatagtattgatccggggagatggttggatccaacaagggtacgtagggatgatagtgagtgaagaagctgccagcattagctaatggataggtaacaaaatttgacagaccttacatattaaacagagcatttacttgatgcccatgaagatgaacaaagtcgagtgacctggacaaggttggagacgtcgtgtcggaaagtagaggcgagggttgacttggtggctgggatgacaaggaatgaacgggagtcgtaggtactactgacaaagatggcacttgggaagccaccagatctacccgcgaccccgaggattcctgaccgacgatggaggaggcatcggcatggtacgattcgctgggggtcagaaggatgccttggagggactgtggcgcggcagcgggaggatgagtggagacggatgagcgcagatgctggacttccttctccagctcctctaatcgcctataaggtatcagaatgtgcacattggatgccagacaatagtgccttcatggccagtgaggtatactctcgcccgttgacgcgttgatacgccgcatcgagtcggcagtcgtagcccagccggcgacatcgggagcagggaatagcaccgcctgtggatacctcacatcgaagctatgccatatcgtcagctacggaaaacaccagaggtgagctagtaccatcactgacctttgactggcgacattgcttacaggcaatccgtttactgcgatggcgcgggaagggggattggggcacgcgttggggtggcatgctgatcggctagacacccattctccgaagagtaagcatcggggagacaatcctgcagcagctgaggtgagaggtaactagctacgaagtactatgattaggtcaacaaccctccaagggagagacagagcaaaagatggtgagtgagtgattaactgtcagcatggtcgggcttcgctcttccctcttctgattatctccgttggcgggccgagcatacccggactgggtttagtgccattaccaccggcccgaggactctctgtgtcatcatcccaatcgggaagtccagggttgttggttaatccggcagatttgattggccattcttccccaactctagagctattaagtcggatgtcagacggatgtgcgacggagcagattcggttatgcagatggatatatttgattggcttggtctacgtgataaggacggcccgcgagtgccacagccgactccgtgcatctcggtcgggatgaaggaaacactgcctctataactagtagttagttatatgtacgcagatgactaaagcatggagtcccattggagggcatcatcggaatatactacggatcaagtcgtttctggaagtagctgattgaatcatattcgacgcgactgaaatagtggtacccgaaggaccccgcagtatattggcgacgacatgtctctgtgcttgttggcaatcacaaaacccacctagacctcgagtcatggacaacatcccgcccgcatcgtacgatagtggagtgaaaacgtcgagttgaaggaagagaatccttgtatgatgctgtgccatacgtacgggtttgcccttctatatggccatgcagtcatgacgttggcgatatgcggtcaatgcttagacgtacacacatgccgagtcctacgccgagatcgcctattcagtgaacggtgaatcgttagattgatcttctctggtctgattcagggccagggagccgtaggggtaagtccgcctccctagcttcgtagcatcgttagttccgcgtctaaacaggattgactaattgctcatctcccacgacgcgtactcaagatgcgaactattactctatgagagtgaacttgataggggatttgcaactgccgagaagcctgtctcatcatgaaacatggcgaagcaggcagtcgttcggtcatctcctttgggaacgggccgtttcccttgcccaacaaggtagtatctgaacctgatctgactgtctggaaatattcatacccttagcgaatgtgttccctagcccaaaataggaaaatattatgagagagtgggacgaaacgtaatcttttgattcgattcttgatgtagtcggcgaatactcggggaatccccgcaacttcgggactgatgctaaacccgcccgggaaagagatctgaatgtgatggtgccgtgcttgtggagacgggaagccgaacagtccctggaccctatctattccacatggcacagtccacatcaagtatggaagccacgcctggtccatctcgcgcaagccacgcccaaatctacctatattgcatgtttacagttagctgaagctgtcaagaccaggctgaaacgcgtcagcagaactctagctttgagacatcaatatatgtgccgtcaattttgtttggggagatcctccactggcaaaaggtggtgaaggcgcttaggggaagctgatacctagagttagctatggaggaaatgatggaagacagagcggagaagttgcgttatccatggatcgtcatgagtaaaatatgattccacctctgtgggttgggagacttctaacattgaaagagacaatgatcgtcgaggtctgaatctataaagaacacgccatgtcccagttgtagcggttaacaatccaactaactgtctaagtcattcgctcgctattcattcattcagtatttggtacatttcgaaaatgttcgccaaattgtccctcctttctcttcttttcagctctgctgcgctgggcgcttccaaccagactctgtcctatggcaacattgacaagtcggccacccccgaagccagggcgctcctgaagtacatccagcttcagtacggctcgcactacatctccggccagcaggacattgacagctggaactgggtcgagaagaacattggtgtggcccctgcgattctcggcagcgacttcacctactactcgccttcggctgttgctcacggcggcaagtctcacgccgtcgaggatgtgatccagcacgccggccgcaatggaatcaatgccctggtgtggcattggtacgctcccacctgcctactcgataccgccaaggagccgtggtacaaggggttctacaccgaagccacctgcttcaacgtgtctgaagccgtcaacgaccatggcaacggcactaactacaagcttctgctgcgtgatatcgacgccatcgctgctcagatcaagcgtctggatcaggccaaagtgcccattctcttccgcccgctccacgagcccgagggtggctggttctggtggggtgcccagggtcctgctcccttcaagaagctgtgggatatcctctacgaccgcatcactcgctaccacaacctccacaacatggtctgggtttgcaacactgctgatccggcctggtatcccggaaacgacaagtgcgacattgccaccatcgatcactatcccgccgttggtgaccacggagtcgcggccgaccagtacaagaagctccagaccgttaccaacaacgagagagttttggctatggcagaagttggccccattccggaccccgataagcaggctcgtgagaacgtcaactgggcttactggatggtttggtctggtgacttcatcgaggatggcaagcagaaccctaaccagttcctgcacaaggtgtacaacgacacccgtgttgtggctctgaactgggagggggcttaagtggatatggtggttttgatgacaagagaaacatagagaatcctttgatggattgtcgagtgtgtggggtgagggatattttataattctattcggctactctgggagtggtcatcatggcagctgatagtcactcgaagcgcctccttagctagcgtgtactattgccattttaaattacacagtgcacttctttgggttcctctgtcataaagcattctagtagctaattctccatgtcggatgacgcgaggggccagctgggcctatagggtggccaagtacttgtagcctctccaggacagatggaatggaagacggtcttagtctcgtcgtccagccaggacagggagaaaacataatttctgacgtggctgtccgctcgtaatcctatccgccacagaatttgtcagtagccttcccttcaacttcagcggatcccatacttaggacctgttcttcctatagcacggtgatgtatgatataggatcgacagacctagtctcaccgatgaggtactgcgtggaccgtggcagtcatgccctctttgaacccgccggatctcgaaccttctcccggaaaatcgatgtgaagctcgtgggggttaacagcgctggtgcaacgaccgtttctttgcgcaagtcagaagtagtcaattgcacggttaacagtgacaccatccgtctccgggaactcacctcatcgagaggttgaatcgtcttctgcaccgattttccagaggcgttcccagatacacccatggaaggcatcatggggatgggagttgctccacggtctaccgatgatgggattcctacattctggtcgttgtatcatagcggacagctggcccgagcctgtttttcccttctacttcgtcccgggctcagagtaccgggctgagctgaccctgggtggagtggataagtccaaattcattggtgatcttatctggaccgacctcaatcgcaatgtgagcatcctttctggggcttacacttgggcttcgtgggtctcgacatcaacgagcggcctgctctcacgactggcaactacagcacggggatcgcgggtggtccgcctgcactgtttgttgctggactgactgctcttggtacaggaacagcgatcctccagattcctgataaagagttaacggaggatctctacaggcaaattttgccgttcattacgatgatcgactcagctggtgcgtggggggctccatgccctctgctggatgcggtcgctccggagctgaccttcaccatcggcacagatagccaaagtatcaccctccctcgaaatttgctcaacttaggcgagtatccggggcagccagaaaactgtcaagcagttttaacagccccacggagccccttgaggatccgatgggagaagggcgcgccgtgtggctggtgggatctcccttgctcaaagcatactataccgcgtggaccggcctggactttcgggtgggattcgccacactggtggtacctttcatgtcctagatgactccttggatatgttggatatgtcgattaaagtatgattaccaagatgctttaggttgacgatacaaagtgacctttcgggtatacacctgtaatttgcaatccactatggattgcgtgttggtatttggacaggaaggaggctgcacgaacgagctgcaaacgagaagcaggatgactatgaatagatattcgccgtgggaagttgcatcacttcgcgagattcaaaaagctagttacacagcaggtaaacaagaaagcaactgctgcggatgcgatctacgcaaggggagggcacagccttatctcgtgcagcccgacatgcatacgcgacttccggcggtgtgaagattgccatgttattggagatgagatgtcacattccagcatcgcaagttctcttcctgttcggaaagcttacctaagttaaaatgctgtgaactgttcacgcagtgattggatggacccatacaggtgagcaggagctgatagataagaagtaagaagtagtaagacggaatcgtacagagtatcacccccacggtattggacttgcccttgaatgtttctcggctcgctgcttggagtggggcacgaatactagtcatggtgtgtgtgtgtgtgtgtgatagagttaatacgaagagtctaagcatacagaatatgtccgtcccttattagattatgtatgcttttgactgctcaggagagtaaaggttttcgctggtaatatttccggtatggataccgtcacgtaatacctcaccggtagttgcaacctagttatggcgccatgatgttgtgtcagcgtgggctggccctaagatccgactggacaaagatctccccgtcagcatccctgcatctcctgctgcttggcgcggcgatctgtctgtgacgtgtccatcagaagggttagtacgtcacaaaggacaatacccgaaagtaagatgccgcctggaaatggttattcggagtatatccggaaagtcaacaaagtcccggacatatatctccggcaagaggaagacaagaagagcacaaataactgtttcatcttgaaacctttcaacgaccagaatatgatggagatctgaccaagggctaccgggtcataccagcggcaggatagacataccagcaaaagaaaagaaaatagttcgatcggctgggaactgtggagatgatccattgttgatccgttgttgtcaattcgcgccccgccagatcgacatacgcttgcggctcatgggttcgatggggatctaattcctcactctctagcgcgccatcctgtcaaagaagtttgcgaagagtcctaggtcgacgctaattactacgcctcagaactacgaaaaactacgacaaagtaggagaaatttccaagaaaacatgacatttttggtttcaactctcattacccatagaataaaaggaacatatacatgaccccgagataaattttgatgatcagacgtagagaagcgccaaagcagcaccaagcagagccacgactccctggggagcgttaaatgtagacgaagccgcgccggtggatagctgagcggtggatgtggtggcagtgctgtttgagctcgaggtagaagacgcggatgtggcgagcgtagtgcccgtagaagacgacgaagacgtggaggtagaggtggccgatcctgtagacaaatcaagcttcggtcagtgaggtcgccgtgccacaatgacgaaatgacatcttgcctgaagatgaagacagaggactgctcaatgaggtagatgtcgaagacaccgcagtcgtaggggtgactgtggtggattcggtctcactggatgtcgaagaggaggaagtggtggtggaggaagaagaagaggaagaggaagaggaagaagaagatgtagtggatgtggaagaagatgatgaggaggaagtagtaccatcggtcgaagcacccttttcgacagtaaaagtcgggctcacagcgagctcgcccgaagagtcgatgatctcgatttcatagtcagacctaggatcagaatcactaagttagtagcgttctccctttcaaatatcggtgagtctacaaggtccaggggtacgtacccgttggaaatgctagggttgggctgggtagtgtattcccccgtggacgtctttacgttgtccgccagcttggtctggaaggatccatcctgggttcgcaagatgatgctgatcactgacggatcattcgcatcgctggtgaacttgatagtcttcggagtggagaaatcccactcggtgcctgaggtgggctgggtgatggtgatggccaaagccgaagagatgaggcttagcgaggcggcggtgattgcgaagcgcatgttgatacgattgggattgctactgatgaggatatctaggaagtagtgtcaagtcttctaccgggaaattaacctgctatatatacacatcgtccttgagaaggggtctctttgacgggatcgtaaaccgacaaaccgtatactcttctgtactgaatcactcagcagcgtttagctgaagcccaaccgatcgggaccaggccgattgtctagaccgctcactgaggcagcaatacgagatgatcatcagcatgagctgaatctctcccaggaggaggaaaaaaaagggacctcaaagtgtaatccgagacattttccacgtagagtgacagcaatcgggcatgaccggaatgtatgtctctgaagcagtgatctgtcatggtgtgctggatatatcacaatatcgggccaatgagatgctctgatacgattggctgtcggtgttctttccctgacagataaagacgcgagctgtgaaagcaagttgaagccatctcgtgtcagcgcaaggttggcgccaggagggattggctgcgatacggaagagccgataaggcgttgggtgatcgaggctgtcaaagatccgtacttctattttggtgggcagtatttggctataattccataccggtatatgacggtaagatggcccaacctccccagattggctggccgagtgtatctgggacctgcggtcatcctgcaagctggcaggctgcttgtggtggtggttgttcttccaagggtaaccgaagccgagccggttcctgtgcgcccgaccgtcagggcgacccatcaaagaaaagaaagcccgtaacagtcgggaaacccgaacgaatttacctccctgtatactgcttcgtctatgccatccgtgccagaaggagaccctgacaattttctttcccccgtgctacaaaagatttcaagagactcagacggaaacaacacatttattttaccgtgatgctagggtgactcgtaagagacaagacgccacattctatacttagtaatgtatcagtgcagccagaggggtggtatcgggtttcaagtaaagccacagtttcaaaacattcaaaagagcgttatgagcaaacaataatcataggggtaatgcgaaacagggaaagacaggcgacaaacagaaggggtagaggctcaaggagactagaacacgtaggacgtggccatcgcaactgtgaccaccaatgtgcttatccccaacggcaccccaaacaaacaggtctctgaacccttggactgggtcaagctcgcggacgaggctgcggagctactcggggtcgccgatttggtctgatcaccacagatatcagtgctgtccttcaggctgtccgtgggatagtacacgcgcggacccccgtccgagctcagatccactgccagattcccgctggaatccgtgacatacgtcttgcacgataagatctcggtcacattctgcttggattggaatccagtctcgtctgagcccaacgtgattttcgtggtggctttgctggctggcttggctcccagattggatacgacactcacgatctgattgcccgcaaaccccttgcgcgtggccagaatgtgcgtagaattgtaaatgggtgctgacaggtacgagaggtaatcgctcccagattgcgacttttgcgtgtactgctcaccgtccccgctagcatacgatcgaaggcggttcagggattggacgagggtggggagggaggtcgagcgcatcgagtagttggtcagccacagagcctcacggttgacaggattgtaggatcctgtcaaatgctgctcctcgccgtaatagactgtattttgattatcagtggtgtctgaggaatcttgcttactatgggggaggcggggatcggaacatacggatggggatgccgtccgtcagcatactgctggtcaggatattgcgcgccagctgctcacaagcaataaagtcaaacattgttcagtaccaagataggaccaccgactgaacttaccgaaatatccgacgtgtatgaaccgaagcgcggaacatcctggtttgcagtaaacgtccccagagccaagacatcctgtatatgattagtttgcccttataatccaattcgaaggcatgccctacctcgcactgtcctttggtgtagcttatggactcggtaatggtgctcaggttcccgttggtcgtgttgaaggcgtcggtaagaatatagtacctgagaaagtcaacacgactgactttactcaccacgatgcggtacttacaatggataattcaaaagcccatttaaacttggctgcagagggcaaacatcagccgcatcggccgtggcaccttcaccgacagtgaaaacccctgatgacttggtgaagttggagaagaagtccggggcgatatttaagacgctgtcaatacgcagtccgtcaactacaaaacagaaacaggtcaatcaatattccataacggccaaggaagaagtcttacttgagtagttcgaaaccaaccccgaaatccaggtaccaagaatattctgaacttgttggtcttcatttcgcagatcgggaagtgatacgacggtgtctcccatccagcacttcatatggggttagcaaaatcccacgggtcatgattcacaatacagacttacatccagaacacaagtttcatttgtggggtcactggagaggagcttgaaatcatggaaaaacttctgatcattgaaaggattaaagttgctgtaatcgacggtgctgtgatttcccgcccaggccatatcaccaaccacgatgtcaagcatcaagtactgggttttgcgcggtcagtgtcatctttagggaaaatggcagagcgactcaccatgccacgatcgtgcagggcagaggacaaggcttccagctccttgggagtgccaaaatgagagttgatggaatacagatcattgggccaatatccatggtatgctatgaaccgttaacatgttgaatttcttacctaccaagctacatagtatatcgtgtatataacaatgtacagagttgcagatggtttgtgaagattttgaaagtgccatacctgagagatctgctgttcgggcggaaatttggctttgtgcgggagagatccatatctggtgtttcaggtatgagaaagagtggcagagagcgagaggcaggatgatggtggtaaacctaccgcatcaaacccgagctcctggatgtagtccagcttattgatgatgccctggaaagagcctccgcagtagtttcctagtgctgcatcacaagcagcggtggttgagttatccgatcgagcaaagcgatcggtcacgatttgatagatagagcgaccgatccattggtctctggaagccgcattaaccgtggggattcccagagttaccaccagcaacgagatgatccaccacccgtcgtccatggttggtggcgtttgcatgcgcagatgaaagaaggcaaggagagtagttcaatggtgggattattagctggaaagaggtgagaaaaaatgtcttgatggttatgacctgcgtaacctcctgttgagcatgttcatatacgaagcggacacatacatcctttgtgtctgttcagggcaagaaggctgataccgaccagtgaacaacacttcagcgaagatgataccgatgtatccggaccgtatggaaacttacgtgacatcggcatcgggaattgtgtaatgggtattgtgtattattcgaccattgggtaaagtgggaataattgggtattggtacttctggaccccgaaccaacagacagacatctatctagttaaccattactactacttactaactagtaaatctgacatcaaactcacggcccgttcgccaggtggttggtttcttagttcctgtcacttccacccgatcggcaggctttgctggtccgagacagtgagagacagactatcagactatcagaaaaagcgcgagccaaaccttaaaacttcccgctatttttctttttcttcttttttcttccctatttcccgtcgggccttttctgtgctccacttctctcccttatcggccttcgtatcccgaaaagatagtctatcccactcacttttttctccttggctcgcttccactatctcggataggtcatctcccttagcgatgacgtgtctctgctctttccttcgttctgagttcacggaatctgcaagtcctgctcgccccatcgagcatatgtcactaccgggtcgatggggttcgtctatctccgatccccgtggcccgggatatatcactggctcttcaaagctcgtccttgcaggaggttcccgaggtgatgagaaacatcatgacaccgcatatgccaggtcgaactgctactatccatagtaaaccatggacgtacctccacttttctcctccccaacaccacgacggatccttccacccccatgggttcttggttctgtgtgagctgtccggtggacttaacccccaccaccgttgagaagccatcatcatgacccactttggctgctcgctcagcctctcaaccactccggaaaacccatatcaatgcatgtcagactggttccggatgagacatgagcctgccagtgttgggcctggaacctcgtcttgaggcccgagcaaggtggcgtggcgtgttacaagctgaattggctttcaatcgactcaaatagacttgctgctcggaatacctacaccctctatgcccaccaaatgtggcgtgtgtgtcagccccaagaactatcggccaaatttaggcctgttcgaccgcctcactcagcgtcagtgcacagaggaggctgtacgggactttgcgttatcacgccggggtaatgcactaatctatgacatgctttccctgcccatcggtgataccctatgaatctctccgcagtttctgggttcatgggatatcctttctttctaggcatgcaccgttctgctgttgttgctgcttgtttgacttcctcatttttctttctgcagttgaggcccccccagcgcgcttggtggatgtcactatagtggcattcacttgtgcagaatgaagctgttcattattttcttccgttatcttttcactatcgcattattgagccgcattgcacaatccctgccacaccttccagaggaggtaaactggaatctcaatcagaatgagaccgcgacaaaccctctcgactattcgggtcagtgggatggccattcatacaccccttctccagataactggcgtttcccattctacacaatattcctcgatagattcgtcaacggcgatcccagcaacgatgatgccaacgggacacagtgggaacacatcctgacctccaaccaatttcgtcatggcggtgatgttcttggcttggttgataccttcgattacctccagggcatggggatcaaggtgagtttgctgcctcgcgttggtagccctggcaccaaatactgacttattcaccttcgctagggtgtctatctcgccggaacgccgtacatcaactttccctggggtgccgacggatactccccgcttgacctaaccctgatggaccaccactatggtacgatcgacgactggcgcacaatgatatccgaggcccatcgaaggggaatatatgttctgtttgataacacctttgggacgtatgtgtgaatacctgtgcctcatattggagcgtgaaatactgacagcggaagaacagaatgggcgatcttattggtttccagggctacttgaacaggtccgcgccgatcaaccccaacgagtacgactacgtatggaaatacgatcgtcaatactgggatttccaaccagggaatcaaatcgaatcgcagtgtccctgggagtatcctcggttctgggacgatgacgggactggcttgaccaccaccaccctcggcgcttcatgccgtgacagtgaattcgatcaagtaggcctctatcctaatattcgcgatggctaccgctgactatttaatccagtatggagaagttgctgcctttggaaattataccgaatgggaagggcagattgccaaatttgcctttgtgcaagatcgtctgcgctcatggcggcctgatgtcctggcgaagattaaacacttctcctgtctaacaatcaccatgcttgatatcgatgggttccgcgtcgataaagctcttcaagtgaccttggatcaactgggtgagtggtctgagtcagtgcgggattgcgctcagcaagtgggcaaagacaacttctacatcccaggagagattgtctcagggaacgcctttgggtcgctgtatattgggcgcggccaccagacgaatcagaccatctccaacctcacggaggccttcatgttcacaaacaagaccgacaaggccaccgaggatcttttcctcagacccacatcgcaatccgccttggacggagctgcgtttcactacacgctgtaccgagcactgagtcggtttctagggttagttctcccgcttaccccctgaataactccttcatccatactaatgtgaccaccttcagcctggatggtatctacgccgccgagggtgatccaccagtcaacttcgtcgagacctggaatggcctcgtggagactaacgacatgatcaacgtccatactggaaagttcgacccgcgccacctgtttggtgtcacgaaccaggacgtttttcggtggccagccatcgccaacggtactcataagcagaatctgggactgtacatcgcaactttactcatgccagggatcccgatcctctcctggggcgaggaacaggatttttacatcttggacaaccaggctgataattatagtatgcattttgagtttccatcccttgttccagttctgacgttctatagttttcggtcgcggccccatgtcatccgctcaagcgtggcagcttcacggatgctacaagctcggggcgtccaaatacgtcaactttccccttgaccgcgccctgaccggatgtggtgacgattccgttagccttgatcatcgcgatccttctcaccctgtgcgtggtctctacaagatgatgtttgaaatgcgacagaactaccctgttttgaatgatggctggtacctccaacaattgtccaaccataccttcgacttctaccttcccggcagtaatgggaccccaactgagacaggaatgtggagtgtgatgaggtcccggtttacagatctacaaaacttcgatggtcagggtcagggtaaccagagtgtgtggctggtctattcgaacgacaacaagacggttgatcatcagttcaactgcagtagcaaagatgcgctgatctcgccattccctgctggaaccacagtgaagaacctcttctatccgtttgacgagtacacgctgattaacagctcggtgtcccttgggtatgattttaccaccccaaagttagagattaatttcactgactatgagtagatttgaaggatcagaactgcccaatggatgctatccccagttgacgatgccggcttggggcttcaaagcctttgtacccaaggctaaattcgtgaagccatcgccgtatataacacgcttcagcccggggcatgatgctcggtttatctctcagggaaacgacggggagactatacagattggtttcgagttctcccaggagatgaattgcagccaaatcaccgactcgctgacggtcacgtctaaagccctcaatgatgagagtgctcagattgacacaacttcagtctcttgtagttcgtttgctgagacacaagtagcgacatggcctggcgccctcaccagtgtcttcagctaccaggtgaatctgaccaatgtctatcccggaattcacaggatcactgttagcaatgtgactactgcagaggggaacctatccaccaacgtaagtatattctccccaatgcagctgcattcagctgggatgctaagtatttcgagtagtcggtggatcatttcatgtttcgcatcggagagacgaacaaccccatggtctggccgcagctggccaactacagccggactttactttttgacaccccatcgcccgcagcggaacccttgtcggtcaggccacaggctccaggtgcagatatgtggcgctactcgctcgacttcggggctaatttcagtccctggatgacatataccgggttcaatacgtccatcccgggtaaaaactggactgggactgcgaagcaagcgtgggatggagagcacatcatagcccaatactggagcaagctcaccgggagtagtgatcactggcagcatggagactctcaatggcaatataaaccaccccgtcgctttcccaacctctttattgagggtgaattcaatcagttcggatacgacgctggttactccaacgcgatgagccttagcaacgttactggcgattgggaaatccacttcatgggcgaatggcccgtacaggttgcgtttaatgcctggggtataaacgaaaatggcttgcccgatcagacgcaagtctttggggatatcgacggcgacaacgttctcgatcaagtcccccccgtcacgctcctgaacaatgtgttcaatgtcaccatcccacccccatcgccttatctggccttcaagctctcggtgaatgacggcgatctgagggtctacgctacccccacgggatctagatgggtccagctggctctctttatcttgcttgctgtcatacctgttgccactgcggtcggagcagtgtacatttacctcaaggctttttaccaggtcaaattcaatcaaatcggtgtcaccgagaaaacttcgactctcgctccgattttgggcgcccttctgaagataacccggacctctaacgagaaggaagccaacccggaggacaaccagcgctctgtgagcccgccaggacttccgactggggccgccattggggctgttgtgaacaccccacgacgcactgtcctcattgctaccatggaatacgacattgaagattgggcgatcaaaattaaaattggtggcctgggcgtgatggcgcaattaatgggcaaaaaccttacccatcaggatctcatatgggtggtcccctgtgttggaggcgtggactaccctagggacgacccgcgtgaaccgatggtggtgactgttcttggaacaacataccatgttgatgttcagtaccatcggctgcataatataacatatgttctgctagatgcgcccgtgtttcgagctcaatcgaagtcggacccgtaccctgcccggatggacgacctcaattcagccattttctactctgcctggaatcaatgcattgctgaagccatcaagcggttcccgcaaattgacctctaccatatcaacgattaccatggtgcggcagctccactctatctcctacctcgaacgattccttgttgtctgtctctgcataacgcggaatttcaaggcctgtggccaatgcgaaatccccagcaaatacaggaggtctgccgagtgttcaatctggatcaggcggtggtcaagaaatacgtccaattcggcgacgtgttcaatctccttcactgtgccgcgaactatctgaaaattcaccagaacggatttggagcagtgggtgtctcgaagaaatatggcaagcgatcgtatgccagatatcccattttctggggtctcaagagcgttggagccctgccaaatcccgacccgtcggacttggctgactgggacagcaatgcgagcaagcagcctgaggaggtcaccgtcgacctagagttcgaggccagccgtggtgcactgaagaaacaagcacaagaatgggcagggctgaaggttgaccccgacgctcagttgttcgtctttgttgggcgctggtccatgcaaaaaggcgtcgaccttatcgcggacatctttccctctgttttggatgctcacccaaacgtgcagctgatgtgcattggaccagtcatcgatctctatgggagatttgcagctttgaagctgaaccggctcatggaactctatccagggcgtgtctattccaagccagaattcactgcactgccccccttcatcttcagtggcgctgaattcgcattaatcccatcgcgggatgaaccattcggtctcgttgctgtcgagtttggccgcaaaggggctttgggtgtgggatcacggtatgcctctagttaaacgatgctacgagtatcaatgctgacgtatgcacttcatatagggtcggtggccttggacagatgccaggatggtggtacacgatgtgagcttcttcatcttatccttgataccgtgcagaggcggagtgctaatgtattctagtgagtcgatgacaacgaaacacctcatccaccagttcaagttggctatcaatgatgctctgagatcatctcaagaaacacgcgccatgatgcgtgcacgatcaggcaagcagcggtttcctgtggcgcagtgggttgaggatctggaaattctacagactacctcgatcttaaagcacgcaaaacactcgaaaagccaggaccgcaattcatggagggtatccggcgttagtacaatggttcccgatagacctcgcaactttcggttttcgtcaagctccaataccagtcgcgaacagagccgttcacgcagctcggacaactcaggtccccccagcaggcccattaccgcggacgcgaaacaagcgggaggtcggccaggccatagccacgttgcctcgctgccagccaatttgccttcgaacgtcaacatgttcaacgactctgacactgacaacgagtcaagacgcagaccattatcctctaccccccgtggaggccctcggattgtttatacccctggcaacgacggccaagatctcgagcacatggcaggggtcgcccaagaggacttcagtcctcatcttgcctcgtatctgtcgccgtcgggggcaccgaatactcccccaaccttcgctaactccggtgccagtacacccactctcggtgccggaccggacgatggcctgctgggacgaaggaatctaagcccgtcaatgatgagtttagtcagcattcatgatatcgtcaaggagaaacaagactacaaccttcagaaagtcaatccgttcttcacagatgccaatcatgaatacgcagccaagtttgaacggaagcttgctggtctgaacggcaagaattccgaggaccagttgtgtatagaggagttcatcgagaaaagcgaaaaggactggttcaaccgataccgagatgtcaaactgggcaagtcaccactcccgtctccatctccgtctatcttccgcttcagagttcaggatgctagccgaccacctacccctgcagctaatggaccagttgaggatccgaatgggggacaattccttctcccaaaggattatgttcccccgacaggcttgaagcgtttcatgctgatcaagctgggcgactggcccttgtattccattgtgcttgctatcgtgagttttgaccctttcccaggcgctccccgaatcacactttaaccaatgattgcagggccaaattctcgccttgaactcctatcagattactctgttgaacggcgaaatcggagagacagcagaaaagttgtacatcctggcttcgatttatctcgcgtcctcaatcatctggtggatgattttccgccttgtcccatccgtttacgtgttgaccatcccttacctggtatgtgaaaccgtttccgaattgtttgccgtctaagctttcattctaaccgtgtcgaagttgtacggcttggccttcctgttcgtcggaatcgcgggccctatcagcaacagcatcagccagacgtggatgcagaatgtgggcaccgggttgtattcctttgcgtcgtccagtggatccatcttttttgctctcaactttggagacgaaggtatgttgatgggcaagatctgtcaattagttttctctaacaatccgtgtatctaggcggggcgcctctcagctcctggatttaccgagcgaccgtgattcagggtagccagcagctgtgcatcagttttctctggtactggggtagctggatggcaagcctcaaccaagagggcagtacgcgctttagtcttagcataactgacccaaacatcttgctcggaatcggcgtcggcctggcttgtgtgttgtggctgctgggggccttggtcttcttcggactccctgcatactatcggcaaacacctggtcaggttccgaccttctacctctcgctcttccggcgtcgggtcatcctggtatgcttctgccgctctgcaccctttttggcctctaatatcgggagctaactgaaatatattccagtggttcttctacatggtgttcatctccaactactggctatcagcgccgtacggacggaactggttgtacctgtggtccagcaagcatgccaaggtctggcagatcatcctgctggttcttctctttttcatcgtagtctgggcggctgcactctgggtctttcacgtgctttccaagcgacatgcttggttcatcccaatctttgccattgggctgggagcccctcgatgggcgcagatcctatgggccacctccaacatcggcacctatattccttgggctggtgggccagttgctggagccatcctcggacgggcactctggttgtggcttggggtgttggatagtcttcagggtattggtgagtttttctgttcctcgtccactgggattctccatttctaacattgaaccgtccacatagggtttggaatgattctgttgaataccatgactcggttccacgtcaccttcaccctcctggcggcgcaggtggtgggttcggtcgccaccattctggctcgagccacagctcctgataaattggggccaggcaatgtcttccctgatttctcggccggggtaaccgccggattgagcaaagcggacttttgggtgtgtctgctgttgatgctctccatcaacgtcatctgcatctttttctatcgcaaagagcagctttcaaaaccatagttattgcatatattgttgtctaattcttttggatcagtctcttagaatgtagggatctgattagcattgtttggagtaactgggggatttttgtccagtgttcatgtttggttcaattacacctgcgctacaaattgtatattttttattggtgatgatgtacacgggacatgtattaattcatacgaactgtgggactccgggatgagggtatatattaatgtgctgatagtggtatattgagtgatagatataattagttcgaaagacagcaatatcccgactaatgttgacatctatcatagtatggaaataaagtacggaaatagatgaattactttatctctccggatcaaggtgatggctcaagcgggataagttcggcccgagccatcccgactattcctgttcgggcctgatctctcaggctgcttgcatgacatttaattaaatacgagatgatttccccctctttctttcgcgtgtccaaacttattccatcccttaccagtccttcttgtaatccgcgttttgttttgtgcttcctgtgagagccgttgttctgccactcttttcagagcaacgcgattctcgttcactcgttcatctcattcgtcgcgtcgccctaaacaacttgttttcgttgcacattactttaagggattttgccccagtcgctcatttccatccaccatgaatcgctcacttttctccattttcatcgctgtctgcgtctatgcgcactatgtgtttgcctctttaacttcgagcgagattgccaactccttgaatgaattggcgcaacaaggtttcgctgccaaggatctcgtattggagattaactccaccgccgatgccggtccaatgcgtgtaggtgaccctgggtatcatgagatacaataatcattcacagttttaagaatgtgtaaccctgataagatgtaggacgtctatacagaaatggatacaatggtcaccgtggttctcacggatgttgagttcatgaccaatactcccatcatcaccgatcaagccgaggagcagaccgtatatgaagggtattcaaatgtgaggtcatcggcccaattcataccagcgaaatatgtaacttatctcattggctgctagttcgtacaatcgctcctcgagctcatggacgccttctccagcagcgcaaccgagttgaagtcgattgactcaaccaccaaggataaagtcccttcggaagttcgcatcctggagagtgccgtggacgtaagtagttcctctattttgaacggctgagattcacactaatatcttaccaggcctatttctataatattatcggcctcttcccggccaacagctcgtacaatgcccaagccagtaaccagaaagcccaggtggacacgcattgcttccaggctatctgggcatttgatctcagtgatggcagtcagtctaccactcaatcgcgcaggaacacctctcttcatactcgacgcatgatgcgaaactctgcttaggttgagctatgtataatttgtaaggattacgcggaggcgaatcgttggccggatggtgactagcggagcccgctgctatgtatttctaacttttaattatcctgtattattttaatattatgactagcactttcaggctttacgctcataggcgaaaattgtttagctgggtatatactttgaatgtaagcagaatctagcgatagcacccctgtggcagcaaaaacgtcctgaggtacataatgcgtagagtagccacagttcgtagttcttttttatcatgaagaatgctcttcaaggtctatatttggcatttagtctcattgctcggataacaaatggcaaattccccctatgggccctgggtgagagccaaccataagacctttcctaatggtggatttcaaatcctagagtgtttgatttgaaatggattagaaatttgataggcttaattactctagagtagagatccgagaataataaattgatcattcaaagccgtaagacccaaggactaaccactgcagactcgtcgacagcctctttcacagtcttcatacactccattctcgtttttaaacaatggcaccatttacccttccaaaatacaagggctcgacggtggacgtgtcaataattcacgcagggcaaacatccgtaccaacagcctatgttttcaaaacccccattctaggccatgacaccctcaatataccgtgctacagcttcttgatcgaaaacaggaataacaatgaaaaggttctctttgacctcggactaagaaaagattggaaagaaaagctgccaccagccagtaagcctgcattgctatttctagcctcgtttcgggcgacgtaaacatatgtcgcacatgatagcctatcatgtaagctgactgaggctggcattgtaagtcctcaaccagatcgaatcgtccaaggcggtcctggaaatcgaacatgatgttgccgatcagcttcgcgcagatggtatcccgttgaaatccatcagcgccattatctggtcccatcatcatatagaccacaccggtgatccatctcgttttcctccgtccacgaagcttgttgtgggacctggtttcaagtcccactctagaacgttccccggctatccttcgaatgccgactctctggtcactgatgatgcctttattggacgggacctggtggagctcgactttactgattccattgagattggaggcttcctcgccatcgacttctttgaagacggcagcctgtatctgctgaggtcgaacggacatagtaagtaactggtcatgtacagcatgacctagataccgattgaccatcgttttcttgtgtgatagtttgcttacactcttttaaatagccgacgaccacatcagtgccctggcgcgtacctccgaaaatcgcttcgtctttctgggtggggacatcgctcatcatccgggagagttccgcccaaccaagcacctcccacttccgagtcagattagtctatggacagtgggtcaacagtcggccgaagcggtatccgtgtgtcctgcctctgtctttgaagctatatcccctgcgaaagctaggggcctagatgcaaaagtcacccctttctacgagctaaatgccgcgatgaacgaaaatctgggagatgcagaggctgcccttgagaaaatgataacattcgatgcaacaagcgaagttttagttattattgcgcatgatgcaagccttggggatatcctgccgttcttccccaaacgcttgactgactggcacatggaagggtacaaagccagaggggcttggagatttttgagggatattgcggttgttatcagtggaagcacagaaaaatagtcattctcacatgccattaatttataacccgaagtctatggcatcactctaagccacttcccaatcatgatagtggtgcggctgtatgtgcggagtggggttcaaggatatattgcatattcactgggtccaactttgagtctaaatcaccccatcgtggccataaagttactgcacaacttatgggtcacgcccgcgtctatacgtatcctagttagctgtcaatcctgttcaagactgtacataaaaggcccaccacatgcatcctgcttacatccgaaatctgagttcattattaacttttcatcccattgcaacatcgccagattaatctttcaaggcccgcttcattccatgctctctccaacaaccgttatttttgtccccggtgcgtggcacagcccacactgcttcgacgaagtcgttcgactgcttcaagccgagggttataatactgatcttgttcacttgccctcggttgaccccatacaacctcattccgacttctcggaagatgtgtctcagattagaaatcagatccaggttgcaattgatgctgggcaaagagtggtagttacggtgcactcgtacggcggacttccgggctctgaagcgattcgcgggttagactggagtacgcgtcaacgccagggccaaccagggggcgtaattcatctgtttttctgctgctccttcatcgttccagcaggaaagtctctgattagttcattcggcggccaggaccttccgtggttccgcatctcagatgatcgtctccttgtgacaccggccactcccaggccaaccttctacaacgacatgagtccgcgggaggcagaaagtgctgtccaaacattaaggccacacagttatcagacattccacagcaaattatcctacgaggcgtggagacatgtgccgtccacgtacctctactgcctcaaggacgaggcgatcccactcccagtgcaaaggatgatggtggaggagatagcgaaaggggtcaacattcatacccatgttgtggatgcatcgcacagtcctttctatacggcaccggcggaggtggcagatgccattggaaaggccgccagccgatctgcggaactgattacggaggggaaattgtaatctatctattgtcgaaaacgtacttagataggtcgaaattaaagacatgaactctagcaggttacataaatggtatgaatatattcttaggtgtttactttgacaagaaaacatcttattggggtgtagctggatgggcaggccgacattagtgcggatgcggacgcggatgcggaaacggcatataatcaaatggataacatttgtcagcaagctgatcggtcatttcctgactccttttcgacgtgtttccggcgcttgttgcgaaatgccagggattcttcctggccagactaatctctttgctctctggcaacaccattaacctcataccactgttactccagcgtagtagatgattcaacagggttatggcggacacacaagaacaggccagagctgcgtctgtttgtctgacctgcaaattgggtaaaaggcaatgtgataagagacttcctatttgttctcgatgcaacaagtacgttgtgctaccaaccatcatgtaacaccggggatcaatatcctaccccccaatgaatactcactaattatcgcgtatcgaacagacttggtaggccatgtgaatatccacccagtccgccagtggtgaccgcggctcaaccgacggagtcggggccatcaatgagtaggatgtcgcccatggcatgtatacgatgtagggcaaacaaacgtagatgtgatcgcgccattccggagtgctcccggtgccggaggtacgagaaatgcttgccaccacgcggatgcttgcttaattgttaccattagagtcgtcgccagttgtgtctacccaccgtctcggccgaagtcccccgcctttgcggacaccgatgactttgggccagacatggagtccgcttcactacttgtgccgacagagatggaggctgcgatggacacccccattggatatcggtcatacatgtcaccacttctagaattctgttagtctcctatctacagggtgttgctctggcggtatttgctcactgctctctcaccccggggaagtcctcacctcaatagctttaccctcagacaccatagggactaacagcctttctcaccacctccgttcggaatggatgaagcatgctatgatggacccctgtttgttccacgccaccctgtttagcgcatcagcatcgattgatatgctgcgctgtcagcaaaacactgcggtaaccctgtatcaccagacctgggctatacgcttgcttaacgagcgattggcacagccagaaccggtcctgacctatggaacactgggagcagtgataccgttactatactataatgttcgtgccgtccatttttcccccaaccgttcagagtagactgttctgaagaattattccagatggtcgcacttgaccacgactccgctgtcgctcatcagaggggtctagtaaaaatgctccttgccacgcccaaatccttccgcaacaacattgggccactcatagccatcgtgaagatgtacgtggccattacccgcagactgtggcttgtgactaagatgttagtgctatgctgtcatttgcatgtatctacgacatgcaacctatttgggactgtctgtactctgaatctgttcgctcctcgagcctgcttcgaaatctagtgtcgagagcggccttggggaacggcggatctctgttccaaaaacagactatggatgggattttggatgtttacgaagccgtctcacgcctcgatcagttcttccacgccgaccgcagcagtacctccagtatagaatgtgagtgggcgcgtattttggcaagatctagtccaacgactccctggaccgaaagccatgattatcttacttcatctgaaaaagtcaatgcatgctgccacctctgttgttccattttctggacaaccctgcgacgacggcaattgcacaacgagcaagccccaggccctacggaccaggatcggcccaatcaggtgcttctaaactatattctgcaggtcgaaccactatactggattcagaatgctcccgaggcattcacctgggttgcatttacaggcgctgctgcgtccactcaaccaggtctgcgagccaacttcatcaaccacgcggcaactgtaatcacggccatcgacagcgaggacttgactctgatacgacaggggtggaggtattttggactgatcaaaaggctcggaggggcatgaaaggtgagcaacatatccgcatgactgctggtatatatttcgaatagtttacgactattcatcgaccttcacatgtgatagcgcattgacggtccactcccagagttcctccgccattttcgcatctgatcccgccttactgggagccgacagtcttccgatcggaagcagatacgccccattatggcattcgagcttcaactgcggcgatacagccgcgaagagaatgctggctgctcctttgcgtggacctggcgcacccagctcgaccagcggctttatcaatctatagagtggggtagatgaaatcgggcctgcagccaggcctctggtatgatgttagaaatatcagaggtgtatgaatggaacccggggagaagagcacctacgtcttaacggttcccgggtgcactgagagtgctaggatgtccggatacctcttggccagctccctgctgtgtaggatattggcaagctttgaatggccatatcgagcccagactgaaaaggctttcatattcatatcggagaagataatgccttccttcggggcgagtttggcatgtccgtcgctagacacatttacgatgcgaacgcttcccttgtcggctgcctcggatgctgtctgctgcagggttgggaggagtaaactggtaagtaggaagtggccgatgtagttgacctacatgagcttatcattagcgtcaagaattttctgtttctatgcttctttccgtttttttagacaacggcgatgaaagtaggactgttttatatgatggcggcgagaagaaggtacactcacagctagctgaatctcaaaaccatctcgtgtttcgtcgtacggaaaacacataacctagttgaagtgagctgaggaactcctttacaagaggttcagtcaagcctgggtcaccaacaccggcattgttcactagcaaatgtaacctcgactcctgcctacatcaacaggtccggaggatcagtcatgagcaccaaaaacgattgggcaatggatgaataagggggattaaagaaaacatcaataatagagaaacaggagacacaccgaatgaattgctcagctgcatgacgaacgctactgatgctggacaggtcgaggttgagaaacctcacgtctacttcacgctccgagcattcagctatgatgtcccgcctggcatgctcgaaccgtgtgtgggatcgactggcaatatacacccgggcgccatgtctggcgagttcgatactcgtgccaaaaccactggtggaggagagagttagtaagggtacgagggaactactaccgatccgttcgatgacaagaacaagaggaaagtcaaaaagtagcaaatgctgattattggaaccaacagagtccacgtacagtcccgtgtgcccgccagtgacgatgacgactttaccagtcagctcggggatagcgatggcggaaagaaggtctttgcccatcgcgaggtcttgttggcagagtcaatgatagcggaaggggaacgttcagtatcccatagggggtgtagaaatgtacagtaacacttatatacttcaagtctactgtcatcttatagatgctcctgctactatacaccaggcagcggctggctggtttgggctggacgtgcgggcgcatctgcggccgcccccgcagccgtaactgcagcatccacgacacccttttttttttttttctgtttcagctggatggaatcctctcgcaggagatgaccagtgctgatgtacggaaagattagatgcatcaccctatacggttgtcgcttcgagagtatcggtcaaccgaaggacaacgcactactaatatgccaagtagacaaaacagagaaagacgaataagaataatcaaagagatacaaatttaaacctaagaacaaggagcatgaagaagaactagatagcagcctacggcttcagcacaacctgccccccccagccactcagcttttctgccgcatccaatgcgcgctcaatctcatccaacccaaattcctcggagtgagtgacgccccccttctcgcccagcgcaagcaatccagaccgcaccatctgaatcagccgtaacacatgcggacgatcatacatgaaccgtccctggatgcgaatgcccttgaacatgatctccccgtacggcagctgaatattccccaaatggccgcccatgaggacacaccggccgaacgaacccagggcgcgaatgccggcaactaataaggacgagtccttgatggtcgggggcgaaaggtccaggtacacattggcaccctcggggtggccgacggctgtctggaaggactgggtatcggtggcctcgttgccagtgatttgcacggttgtaagtcgttgcgtgccgtggatgtgttcgagcttgtccaaagctgccctgttgcgcccggccgcgatgacggtggcccccatggccagggctgcacccaccgcgccaccgccaaaacgccccgtagccggggccacgatcaccacctcccccggtttcacgtccacctcggcgagcccgccaaaaggtaccaggtatgcggtcagaaggcagaggtcggtgatgctgtatcccaatcgccccaagagaatttcctcgtccagcggatacaagttctccagggggaaccgcgtgtattcggcgtacgttccgttgcgccagactccatccatgagtttctgcgccgccgggtggattgccccgtgaatcccatagagcatggtcacggcggggttatcgcgcgcgcggatggtaatgtcgcagaagacgagctgacccggcgtgagggtgacacagtcgggtccaacttcatggatgcgcgcgatggccgtgttcccgagggtcatggggatggacagcgggtaagggcgtcggttggtgatgacctccctcatgtaggggacaatatcagcagccaggatgcggacgatggcgtcaccagtcgatgccaccgggcgagggacattttccacaacaagcggcttgtcccgggcatgaatcactgcggctttatgggttgacatcttgtcgattcattcgtctgggatgattgctggtggtccctgatgtgtagagcattctgatgcccgtcctttgcccttcatataagatagacaggtccatggtaggcgagaatgttatatccgcaaactccgaccaacccccaccaactaagtctggtacaccactgtctactgcggagtactgagactccatccgtcacagttgtaacaaaagtggacacttctaacaaccaatgaatgccaagtatatccctggacggtgggtttcaatcaagcttaacacctctgcagcttaacacctctgcaactgcttgggcggctctgaattcacggaaacggcgattaagtcacactccccgccgtaactccgagcccttctaccaattagcctcgtatttcatgaatccgtgggcattgtacaaccggcaatgccgcacaccgcacccgcacccgcactcgcatcgagataattggtaattggcgagatggtcggatggtcgagtggtgacctttccgccgacggtaaagacagacatgatagtatttttccacccatctctgaatacaaagtgtagtctgttggggacaccccgagctgaggagttcagcagtgcctagctaaaacgaataatctgtagagaacgcaatagaatcagagatttgtaagtggtacttggtttctgctagattccagattcaagaagcaagcaagaaacgagaataaagggttggacgaaaggtgttaagcatcacttgacaggaaggaaggtgcctgcagcatagttcaacccaatcccgcagctactaagtagtaactagaccagtgtcatattagagaggtatattttctctagtcgtactatccagtacagggaggaaaaatagacacaataattttaatttctggaatgtttttcttataatcttccgcccttctgttgccatacacagctcctaagaataataatctactttaaaccgagaacttcgatacaaccctgaaatatgtatagactctagcagggtctactgtgattaaattgaagagtagatgtacctatatacacttacacaaatgcgcacgattaaagaacacggtctaacgaataattgctacgttagtcattacatctcaagttgaggacatgctgaatactttgactccaaagcatatgcctgaaccagaatatacatcgacctcttcgaacctggcattctatgctacctcacatgctcaaaccaatagatagtagacatattcatcccatcacaccgacagccttcagacccaaactgccgcgttccagtcgtgccatcagtccctcatacacgtccgtgtctttgtaagctttagccaggctgttggcgacatcacccatctcctgctcaacttgcgatcgcaaagatctagaactctcctccaaaacgacattttggccacctgcagagggccgcacggcatttgtactgaaggttaccgcatcgagtacctcgcgggcagacaccttgccttgaacatcggcagtgccttggatgactgggtggtgcatttgtcgttagcctgctctcgcgtgcgcacgagctatctcaagcttacctggcctgatcaccgcaaaggcatcatcaaacccatcttgcccttcgctgtttaagacgggactgtctcgtgcgcgtatctgcttggtcgctccgagcaccacgagaaggaaacgtccgtatctgttcgcaacgccttgggaatgccactgccaggccgtgtgttcgggacagtcaccccggatagaggcggcaatggataccgccgcagacaaccctcccgagactgccaaatgcacgccagatgaaaagtacgggtcgataaaggctccggcgtcaccgacaatgcggaggtacgggctgccgtacgatgacgcattgtaggaccagtcggacgcctgtttgatttccccgtcgaggtttgcgggctgcagcaattgcgagattacgcgtgcaccctccacagactcaaggtagaaagcccggctggatgtcacggttgatgacttctttttctgcgtggcgagttcttggttcatgacgacgccgacggatgtggtcccgttgtggagcggaatgaaccagacccagccgctgccgtctgacagcgaggttagaaggaacgggaggacatgaaactgggatacataccttggagggcttcaaaatatggctggccttctaccgaggtgccgacaccgtatggtgttgctccgcgccagtaaccccagctggcgacattcttcaagtagctgttgtaggtccgagatttcaagtacttggtgctggcgatgccggctcgtccgctcgcatcgaccaaataatcaaagctgatggaccccgtgcggccatctttagccttccagctggcagataccggtctcccggggtggtcgtcgatcgcggactcatcgagtggatcaaactcaatggccgtcaccttgacaccgtcgaaagccctggctccggaattagatgcatgcttgaacatgaggtcgtcacattcggagcgcacaacgttccaggcgaaggtatccgccccaggttgtaggatgaaatcggtgtctgcgagtgatccgtgagacgcattctggcaatgagaagggaggcctcacaagcttccttctggttattcagcttgaaggctgcaccattctaggctcgattaggcggatgcgggtgaatcaagcgagcattttggggcatactttgcggacgaagccatagttcacgaacgtctcgtcaaggtcaatgaacctgagaaacggccgcatcgaggcaacaaggctctcaccgatatggtagcttggcacagcaccgtgagcttccatccacgggataccgacgaggatactcttaccgagggaatacatctgcctccagcaaaacaatgtcaatgccttctcgggccagggctgaagccgtgtaggaaccaccagggccgccgccgatcactaaaacagtagctttgtgggggatctccatgattagcgcggattgttgttgtagatcaacggggggataacttaaagctcaatggggcagaaagtttgttgaccgcaggtcaaataaataatcaatcagtgcgtggtgctaaagattggtgacaaattggctagagtccatacaaatattaatgacgtgtaaggatgagcacctgacgtgtaaccggcgttgtgcatctcaaaacgatggagagcagtgttgtcgaccagggaagggcagaagtgaagaagcaaaacgaattatggatctgagttgtgagacaggggtcctgtgtctacgtctcactgacaaatagcaccagtggccggtgaggattccagatgctgagggaaaaggccatggcccgctgagcgttttgctttttttagccctctcgatagttcgtgtggccacctcgaaccaggccagtccgcatcttggtcgaggttgtacgaactcgagctacgcatttagtttcaaccagcgggtatctccgcagtccgggttatttgtgaccaaggcctgcattgactaagaccagggcttgatgttgcagtatgcccacccatgacgagactacaactggcgactcttacattaccaaaagatcgtagccacgacgatcatcaaatcatcagctaggatcaaaaagaaaattgggtccagtacacatcataataatcagcctgtaatgatacaagtctgtgttctatgtgaagcaaaaggccacatatgtggaaaagaaagtcgcaaggaatcatgagattttgcatctacctgagcacatcctgggccaggagccccaatgtttgcagatgcgcgccatgtgacattatcgacatacagttagagatgcgtatgtgatgctgcaactcttgcttcatatccaccagttccttctgcatgttcgcgatttccagttccagggccttgcgtcgccgctcttcctcctgctgctccgcttggagcaaattgatcaggtctgcctgcttctgccgcgatcggcccgcagccaaccggttgcgttccttgtatttctcatggtacttcttgcgcaactgcttcacttcctcgctgcggtccatcgatccagggctcgttgctcctagcgaaggcgatttcgccgacgacagccctggcctcgatgccggagtactgaatgctgggcgtgatctggatgccctcgtgattccaggcattggaactaccgcatccaaggggggcgacaccatcccagccagctcaaccgacgataagataccccctgaatcgtcgagaaaggcgaggtcggccgtctctttaccaaagtccacatggttggccacagtcggcgagcctagaaggccctcgagctgctcaaattgagacaaattggcgtcgtcggcgctatacctacaaacttgttcaatcataattcacttgtgtagagacgagccatggcataccctaacatgtaatttcccgagattatatctgaccctgacgggctacctgtacctagcacaggaagatgatgtgaagcttgtaaaagctcagacgcaatttcgaagccatccatggcaaccgaggtgtcgagtcagagatcctccacgtcgagtgtgagagcccccttaaggaatgtggtctgcgaggaggtcctcccttttaatgaggtcgcagctagcacgtccatcctgctaatacacccttcattgcaactggagtagctaaactgcccaggatctgagacagcaaggatgatattcggaattggtactaccaatagccgtgccaatgcgttcacgctagcagactgccgctaaagcgtgcttatggacttctgaggggtacggacatgcacaactggggcccgggccaaccagagggctgatgcagttgctccgcacgaagagatctaaggccagcgcccttgagccggactgcctctattgcattattagggatcgaccgtattttggccacagccaatacatgggaaagggaattccccagtttctcgactggctgctgctgggagattattagcccacccttgttcggccggggcaaagctgtggtagggcggacgccaaaacaagcaacccagtgaatctggtgggacggaggatgaactaacgcaatcacatcgcgatggaaggaggagacaagattacggcaacgctagtacttgagcttcgataacatggctgaatcaatcctatactccgaactccggtaaaagaaagccgttctcagcccattcactgttctgagccaatctaagccattgctttttcttgccttgccttgcctttgatttgcatttctcttgttcttgcatatctcgtcagcttcctcatgacgaagcaatctgctatctggctaattatctggcttaccatgtgcgcgaccacttctacacgtcatccgaaatggacgacttgtggtcccatgaaccacgcgacaacgctgaacaacggggatatttagggataagtgtacgtctgctaaagttgtgagggtgatcagccaccagtgcataaccccttctcatcattgttctcttattattagtattatccttttattcgtgtttcgccatgtccatcgatacactgttatacacaagcttggccgtcggggcagtctatctagccagcgtcgcgctgtatgagctgtattggtccccgttggcccatatccctggtcccaagttggcggcttgcacgcgcctttatgagtttttctatgatgtagtttgtggtggccagtacaccttcaagattgccgatctgcataagcaatatggtgggaatgacatgaaccagcccgactaccagactcaatagcccctgttgtgctgatataaggcaggccccatcattcgcattagtccccgtgaaattcacatccacgaccccaactattatgagacgctctatgcaaccaacagtccccgaaacaaggacccctggttcaccgcgcactttggcgtggatgaatcggccttctctaccctggattatcggctgcatcggtcgcggcgcgccatgatcgccccattctttgccaaagctcgtatggacggggctcagcctttgattaaggccaatctcgccaagctaatccgccacttggatgcccatgcaagttcccagtcagtcctcaaggtcgaggtcgcgtacaattccttcacgggcgatgtcatcaccgggtacaccagctaccgatcgttcgaatatcttgagacaaccgacatggttcccatctggagtgaaaccgtccgcaacttggtcgagagtgggatgctatcgcgtcatctgcctggattctttcccctcctggcatgggctggttcgcggtgtatcgcggccgtgtatccgaagttgctgccagtcatagcatttcggatgaaatgcgcccaggaggtgaacttcatgtggaccaattctgaggaaggcaaaaaggaggccattcagtcggggtgttcggagccagctctgttcccagagttggtgagtcgggcttcctccgctccggatatcacagaggagcgcttgttgcatgaatttatcaccatcgtcgccgcgggaacggagactaccgcccatactatgacagtctgcacatttcacattgcccacaatcaatctatcttagacaaactgcgcgaggagctggataacagatttcacagcaatgccgacatggatcttcagactcttgagcaactcccatacttggtgagaatccctatttatccaacgcgtcagacaagtgatacttactgacaatgccgccagacggggatcatctatgaagggctacggtgcgtatgtccttaattggcctgattagtctgacttatttacgcagactctcttatgggctatcgcatcgacttcagcgaatcagtcccatcgatccactcaagtacaaagatattgccatcccccctaatgtgggtatctccgcttccgacacagcacccataggctgactgctgaagacccctgttggcatgtcctctgcgttaatgcatcatgacgagagcattttcccgcagtcgcacgaattcatcccagaacgatggaccgatccgaacgaccgaaggagactgaataaatacatggtatcgtttagcaagggatcacgccagtgtattggcatgaagttagtattctcgtgatggaatgtccgaagttcaccaaactgattgcccattccatagtctggcttttgcagagctctatctgggcatagcgacgctgttccgccggtacgacatgaaactccacgatacgactctggatgatgtccagctacatggtgacaagatgctgcctcgcgccaaaaatggcagcaaaggggttcgggtgaccttacgacgcgctcaaagcgttggttaggttatggaatgatgggattgttgcactggggtccagccgcgaggttcgtagcatgtgcaggtgaacggttgctagataaacacggagtccttgccaatatgatcctggaattacgaccgtaacagttcctttgtagcagttaattattcggaacggctctgtggtcctgcacaagggggattgatcttcagtccattttctgggtgtacgtgcaatgtccatgaggcagtactcattcgggacgataacccgaccaaggtccatatcaactccaagtcggtattttcaactcagacagcgagtgtcctgttcaatcacgataaagggccgcgctatcacttcggcagttatgttacacgtttggcagtttaatcgtcaggcgccatgcgccacatggtttatgacgtgtaaccccgatggatgaggtgtagaagtggcatatgaggtcatgagcatttttcaggtcaatcatacttatagtcgtcgctggctgtggccatccaaggacatccaaaaacaagtctcgcttttcttccggaaatggatttgagaactggctatatgttcccttgtcttactgatggacagttcgttgaggacgatacgctccattcggttgcgctcggtatagacagcccgatatcactaagcaatggacctgacggcgaatgggcccgggagctatcaatcgcgtgggccattcttctattcacgtacaatgaacaagaggctgttgagtttgcctgtctacgcaaccagcattggttctgcgtagacgcaaaaatgaaccgcgacctctcctggaaagacattgaaatccacgaaggtgggacctcggatggacggcaggtcaatacgggcctctgtctctcacaggagggagcgacacctattcccacagtaagtatccatgatgatgttgtcgaattgaggtagctaatcacagtagcgtcttcaactggtgctggtcggtagtatttccgggggaggcttgtctctggaataccggccaaatctgctcagcgctgaacaggcagccaacgttgccagtaccttagagaccataatgcgggctctgcaagggcgcacagtctccattggctccatcgatgttctcagtgagcgcaatattaccgacctcaaccggttcgctgtcgcccgacgtgcgctaccagaaggttgtctggacgatataatcacagcacaagccgttgaacgcggcaacagcatagccattgattcctgggatggcacattgtcatatcaggagctagatactctttcaacacttctagccaagtacctccgctccttggatctttcaggcacatatgttcctctttgtgcggacaagtccgcctgggcggtggtagctatgttggccattctcaaggcgggcgctgcatgttctccgttagatccgtctcatcctcgaagtcgcttacagtcgatggtgcagctctgcgatgcaaaggctgtcatagcgaccgagcgacacgcttcgctgctccaaatggatggagtggaggtcgtagtcgtcggccccgacatgtcctcctttctacagcaccagatctctccagcagaggccccaggcccatctcatagagacgttgcatttctaatgtggacgtcaggaagtaccggggcacccaagggagtcattctagagcacacagcactgttcatgagcatcagcgcatacgcagcggcaaaccagttctccgctgaaacccggtgcttccaatttacctctttcacctttgccgttagtctttgcgacatctttggcacgctgagccagggaggttgtctgtgtatgccatccgagacccagcgactcactgatttgacgggggcactgcgggagctccacgccacgttctgctggctcacctcaacctcgctggcggacctgaacccacacgatttgccagacctgcgcagtgtcactgtcgggggcgaaagcctctctcgggagttggttgctcgatgggccacgcatcttcggttaacggtctcgtacggcacaacagagaccgctggctggtgtctgctcaataccggattgtctccgacgggtgatgcccgaactctgggcagaccgaccatccccggtgtgtggattgcccatccggacaatgtcaaccgcctggtgcccgtgggtgcggtgggagagctactagtggaagggccgttcctggcgcaaggctatttggacgatgaagagcgcacggcagctcatttcataccgcccccaagctggatgacccaatttcgtccgcaggaagtcacccgactataccgcaccaatgacctggtgcgctacaactccgatggttctgtgagttttgttggacgacgacaggcccatgccaaaattcgcggcaatcggatcagtctacccgagattgaggcacaggtacgccactcctgcaaagatgcgcaggcagtggtggaactggtgactaccaaggatcaggtcgagatgttgacggcatttctggtcgtgtctggtcaggagtccctctcagaggcccccttgatctgcccacccaatgactgctttcgagagacagttacgaattctctctctgtgcttgaacaatcattacccagctacatggtcccaactgtatttgttcctctgtcccacattccgctaaccagaacgaataaagccgatagacatgtgctccgcaaactggcagaggccatgagcagagcagatttggtgcagcttatgacaaaacctcgacctgtcgagcaactccccttatcacccctagagcggcagatccaagggctgtgggcagaccttaccaatattccggcagaaagcatcggaccagacgacaacttcttccatctcggcggggactccgtcctcgccatccaccttgtacccttggcccgtcgacatggactctccctgaccgtacaggatgtgtttcgttacccgaaaatgaaagagttaggggcgcatcttgaacaggaagcatcacaaggatcccagcgttcgaaatcccagcctatcgcatctttcgatcctactccatggaagtcggtagcagcacagcaatgtgggatagacgagttggccatcgaggatgtgtatccatgtacagcgttgcaagaaggtctgatggcactgtcggcacagcgaacgggtgcctatatcctcagcatggcgcagaacctctctcctacggtggatttgggtcgcctattggaggcctggcagacggtagtgaaagccgtaccaatcctccgaacacgcatcgtacgcctgaccaacgagggcttccaccaggccgtggtagacgaatcaatcgaatggcagtccgtcaagagtgaagctgagttccgcagaatgaaccagctcaatcccctaggtttaggcactcgactagtccgcttcgcgctgttgctatcagcagccgatcagccctctcgcctgctgctcgcaatgcatcactcggttttcgaccgctggtcaggccccttgctagtgcgagcagttgaggacgcctatcagggacagccagtcatgcctcagtacttcaaagactttgtatcttacgtctccacctgtcccagggaggaggttgatgcgttctggcgacaccagctctccgatgccgatccgacggtttttcctcccactcctgaacccaactatctccccagtccgaccaagtcgagcgagcggatcatcctgctccctttgagccggactcatgtcacaattaccacgaaactgcgcctttgctgggcactcgtcttatcccagcatacggggaatgctgatgtcgtgtttggtgccgtatccaccggtcgtagcgcacgagtcgagggcatcgagagcctgatcggtcccactttggcgacggtgccattcagggtccgcatcgacggctctgctatggtgtcagatgctcttcaagccttgcaggacgatgccgcaacgatgcttccctacgagcaacgaggccttcagaatatcgcacgcatcagccgcgaaaccagagccgcctgcaactttcagaatctcttaattgtacacgcgcccgattcaagaggccactctaccatactgaaaataacggatgaccagcaactactcgacctcttttcatatggcttgacgctatcctgtgaagtcctggatcaagatcggatccagtgccaggcattttttgacccgaacatgctcgagcacgcttacgtgaaagtcctgctcgaccagcttgctcatgccgtccgtcagatacatgcagttccagattgtaaagtcggcgagatttcgctcctcagcccgcaggatcaacagcagttgcaagagtggaatcctccaatcccgcggaccgggctcaccattcatgagactatccagaggcaatgcctggctcacccccaaaaagaggctgtatgctcgtgggatggatcgataacctatagagcccttaatgaattatcatcgagcctggcgtctcagatactgcaacgctgtggccaacctacctcgttcgtacccttgctcatggagaggtctaagtggacggcagtaaccatgctggctgtaatgaaggccggaaaggcatttgtcctcctggatgcctcattccctgtggagcggttgcagtcgatttgctgtcagctcgacgcaactcttatactttcttcaagcaaacacgccgacgtggcacaacgcttggtatcgaatcccctcattgttgatgccatcatcggcttgcctggtccatcactagcgctgcctgtggtacatccagacgctaccctgtacgctgtgttcacctccggatcgactggcaggccgaaggccgtccttattagccacgcctcgtacggcagtggtgcagaggcacacataccagccgccctaattacccccgcaacgcgggtgctgcaatttgcctcgtatgccttcgatgccagcatcattgaacatttgagcacctttatggcgggtggctgtgtatgtgttctctctgacccggagagaacctcatctctcgcggaggctgtcgcggcacaacgggccaacttcgcctggttaactcccagcgtgacccggttcattgacccgcaggattttcccactatggatcgtctctgtctaatgggggagtccatgcgccgcagtgagattgagagatggtcatcgcgggtgaatctgatgcaggcatacggaccagcggaatgttctgtcctggcgacgctacgacccagcctgactacacaatcagacccccgtaacattggttgtgcgcggggctgtcacgcctgggtcgtagatccagagaaccatacccgactcctccccattggggcggtgggggagttgataattgagggtcctatagtgggacagggatatcatggcagtccggaacagacccaggcagcattcccaccggtaccagattggctgagtgactaccacgatggtgacctctcccaagtgagggtctacaagactggcgatttggtgcagtattcccccaagctggacgggtctctgctgttcatcgggcggaaagacaggcaggtcaagcttcgcggccagagactcgaactgagcgaggtggaatatcacgcgtaccataccctggccggaacatgggaacttgtggtggagcttatcaattcgcaacataacccggcactggccctattcttggcagagaaacaggacagtccgaagccctgtggggtcctttccatgacacctgcttggcggagtgttatgagccgtcttcgggatactctggcgagccgattgcctccttacatggtaccaaccgtgtggatccctatcactcaaattccgctctcttcatcgcagaagacggatcgcaggtccttgcaaagtctggcaggggacctcagcgcagaacaataccagacgtatatcctggcctcctcgtcggaagccacgccagggctgacgcacagccatctgaaagaagtgccgctcaacgagaacgagcttgtcctgcaggacttggtcagacaggtatttaccggcgaagatggatctttgtccgtggcttccataccaatggatgggttgttcacggatatcggtggcgattccctaggcgccttggcgttgacttcgctggccaagcagcacggatttcactttacggcgggggatgtgttgggctctagtcttggagagttggcaagtttgagacatacttgactatttggtaataacatcactacacattatgtttagatagtttcgtgaccaggtacaaacgcatcagactcgtcacttcaacttccgcaaaaggaatacaggagaaaactatcccaaggaaaagaaaaaaaaaaaaaaaaaaaaaaaaaaaagaaaaaaaaagaaaaaagaaaagagaagataggaaaaggaaaaagaaaaaaaaaggggaaggaaaacaatttgtacttgatggtcctagggtaggttaccatatcgccttaggcaggcccaaccattggtcattcgatttgtcctgctgctcgatctgcgaacactcaatcgacaacttgtatgctcccaacaggaattatattacatgagaccagcactgccattaccaccatcacctcaaccgagttgagccgtcgtcggtgctacttctccatctcttcaaccacttcccgctggatcccccgactgcggatcaaaagcccgtttccatcgaattcgagcatatgcacatcatccattactccctttcctaaccttccctccacacgcgaatacacccatacacggagtccctcggcaatggtcgccaaaatttggacacgaaagtctggactttcatctaggacttgtggccagaacgcgagcagctctgcagtggacatggaaggtaaatcattgtgtttgaactgcgcatctgggtgaaggtagtgctcgattgaagctgtctcccgacgatttacgatggtggtaaggaaggtttcggcacggcttttgaggtccataatttagctaagcgaataagagagtaaaatggtttgggttgagtagcttcaggtgtgtgaaatggagagaacgatacttcttaggattgtgggcaactttcaccccgttagcaggggctcttcacgatagaagtacctgttgggccagttacccaggtcgtccattgacgtgtaaatatgcacagttgacgtgtagaggacatctacacgccagtaatgatgggcacacctggaagtcacgttgatgcgattccgtataaaaaattcgttgcacagcaccttacggagacccctctgcctcttataccctcagagtcgaatttctaaaaagttgtccacacatcatgtcgtccgctccgatcccccaatccgagcctctggccattataggccttgcatgcaagtacgccaatgggattgactccccagaggcactttacgagcaggtcatggctgccaggtgcatgcatggcgcaatgccgtccaaccgtatggacgcctccttctactatcatcctacgtctgaggcaaccggcaccagttactcgaagggtggctatttcctgaactgtgatctgaatgcatttgattcccccttttttcagctgtcggagatcgacgtcatggctatggatccgcagcaaaagatgcttttggagaacgtgtatcacgccctcgagaatggtatgttctacttagagcattggcaccaccaaagctcatggtccgactgatgtatccttaatatagctggtattccgttgaagaatgcgatatcatcacccacatctgtcttcgtcggatgttccaacaatgaccacctcgcgctagccaactctgaccttctactgtcccttaagggcaaaggcaccggaacaagcccgtccatcctggcaaaccgcgtcagctggttctatgacttccaagggaccagccaaacaatcgatacagcctgctcaagtagtttggttgcctttcatcagggctgtatggacgttcgtgccgggaagtccgccatggtctgatagccttacccaccagcaaaatatattctttctccattggtcatgcaacctctgaagaccctatgctaacctacggactagtcaatcattagcggtattaatctcatcgagcaccccgggccgacgttgtacctttccagtcttggggtcctctctccagatggcaaaagtatgagtttcgatgcccgcgccaacggctacgggcgaggcgaaggcgtcggaaccgtcatcgttaaaccccttcaagccgcccttcgcgatggcaatcgcatccgggctattgttcgcagtacgggctcaaaccaagacggtcggactcccggaattaccgtgcctaacccctcggcccaagaacggctcatccacgatgtctatcgagtggcggacctggatccgagacgcactgggtacgtggaagctcacggtacgggtacgcaggtgggcgatcccctggaagtgcaggctattttagctgcattaggtgttgcccgcgattcgcccctctatgttggatcggtaaaatccgtgctgggacacttggaaggtggcgcaggactggcggggctgatctcagccacactggctgtagagtcgaagatgatacccccagtggcaggcttgcagagcttgaaccccaagattcctcaacgcgatgacctgaaatttgcaagagaggcaaccccttggccgcgatgggatgtcaggcgagcttccatcaactcgttcggatttggcggcacaaatgcacatgctgtggtggaggacgtggaggggttcttcgcggatctttttggtcagtatatccctggagcattgcccgcgcctgaagtcgatactagcttggaaaccaccccaatgctgtcaaagcctcttatgtctggcaatgcttccaatcagtccgtccagtcctggtcaacaagccggcttttcgtgatatcggcttttgatgaagcgggaatccagcggaatacatctgcattggcagagtatctagattccaagagcactacagcggatacagatggagaggatcggttgctcaacaatctgtgccacacgttgaatgagaagcgcacccggttcgactggcgcagctaccatgtggcagacagcatcgccagtctccgcgagtccttgcagcattcgcgggctatccgccagtcatctgctcccaagcccatccggtttgtcttcaccggacagggagctaattgggcaggcatggcgtgtgacatgctgaaatatccgcttttccggcggagaatacaggaggccgcagcgtacttgagggagctgggcagtggctgggatttatttggtaagtctacccagatttctttttgaggcttgagggcaacgacgactaatcgcaagtcagaacggatgacctctaaagcaggggagttggatgagcccaccttcgcgcagtcctcctgtgttgccgtgcaagtcgctctggtggaccttcttgccagctggaaagtcgtgcctgaaacggtggtgggacattcttcgggcgaaatagctgcggcatattgcgcaggacatatctctcggcaggcagcatggaaagtagccttctgtcgaggcaaagtgtgtgctcgacgaacagacgggcagggtcgcatgctcgcagctgccatgccagtccatcaactggagcgagtggtggcccgcgtcaacaagggtcaaccgacatctgtcaagattggttgttacaatagcccgagaaatctgaccctgacaggtcgatatgatgatatcctccggctcaagctggagcttgatgatgttggcgccctgaatcgcatgcttcccgtcaaagtcgcctatcattcagattacatgcaagacgctgcaccggagtacttgagcttactgggtgaaatcttggatgggggtgataccattcataaggatgcctccatccagatgatctcgtcggtgacgggacagccagtgcccgctggagacgttcagcaggcttcgtactgggtaaaaaacctcgtctccccagttcggttttgcactgcccttctggcatccatggagtttcctggaacgacaggcaaacgagaggatacactcatcgaaattggcccacactcaacgctgcggagtgcaatcaaggaatcattcgccgaagtgcccgaataccagtccgttcagtacggcagtctgctaaaacgttacgagacgaacggatctacaatcttgcacacgcttggaatgatgttctgctccggtcatgagatcagtttggccgccatcaacgaccgtcgcgttggaacgcggaagattcccatgttactgacgggcctgcctggctatgcgtttgatcactccagatcagtgcgtgggacttcgcgtcggattgagcaggtcaagtttccgacatacaaccgacatgagttgcttggagtaccggtcgaagacagcaacccctatgagcaacgatggcggaatgtcctcaggccagatgatctgccttggctacgcatgaaccgagtgaggcttcccagtttactaacgtattgagcccctaatactgactcaaccagatgaaagggcaaatccatttcccgggggtggcatatatattgatggctaccgaggctctgcaacaacgtgtcgcacggacgatgaccatccccagggtaaggatagcgaatatgtcgatcctggctcctttacaggtgccggatagcccttctggcgtggagatacaggtctctatctacccaacgaatgtgcgcgccaacggggcgaccgattgggcaacgttccggatcatctcctatgacactgcggagaagacctgggttgagcattgtgttggctcggttcgagctgaaaccggaccacctgatctatgtgtgaacactgcgctgcgaaagcagtgcgccgagccagtggacatcgcacagatgtatcacggttttacagcggctggcatggactttggggaaaacctgaggaatatccaggccatgaaggtgtcgcccgaccgcacagcctgcacagcgaccatcacagcccctagcatagctccccaggcccacgatcagtaccccttacatccttgctcctttgaaagcattctacacgccctactttatctatgcgaggcttcacagagtcccatggtgaccaactacatcgaagaggtggtgatcgttaaccccaatgacacgggagcccgtgaattcgagtcatttgcaagaaggcagcgtacgtcagcaacgacgtggacgtgcgatgtgagtatcaccacaaacgtcggggaccaagacattcagatcaaaggcctcgatctggtgcagctacctgcgaacaacgatgatgcggtggatgcggagtcgttctacaccgtcaactggagaccagatgtcaagctcctcgcctctgcagacgcgctgcacaactctgccccggtagacgcggcacagcacttgcccacgtttgatgagcacgagggataccagctagcctcggcgatattcctacaggaggcaaaagagtatgtaacccgaacggggctgccaccactcccaactcatcaccaggctttcatggactggatggaagaggaataccaatccatcaacaatggcacgactcccttacttgacaagtccctgctggatggcatccgggccgatccagatcgccgaaaatctctgctcgatcgagtagcgcggcagagtgcccgaggagagctgctggtgcgcgtgggcacccgcatgatagatatcttggagcagaagattgactgtctggaagtcatgttcggcccagacaatctcatggagcggacgtatgaagagggccttccaggacaaattgctcccgcggtggccgggtacctgcattgtctggcccacgcccagaccggcatcaaaatcctggaagtcggtgctggcacaggcagtgcaaccaaggtcatgctcgacagtttgaggccgaccgaggcacaagatggcggggggttggtgtcctctgtctcgtcctacgacttcaccgacatctccgccgcattcttcgagaaagcccgcgcgcgattccacgactgggcagatatcctgcgtcccaaactgttgaacatcgagcaggatcccgccgcacagggcttcgaactgggctcatacgatctcgtaattgctacgcatgtatgttgttcctccccctgcacccttgccaacaacctgatgagtaggactgacgtgtggaccaggtccttcatgccactgccgacctgaatgtcagcttaaagaacatccgagcattactgaaagagtaagtccgcccctttccccagggacagacgtttcatcattgacttgaccacagaggcggtgaccttatcgtgatagaaaacatccaacccaagttcatgtgctcccaactgcctttcggcctcttacccggctggtggcgcagcgtggagccttaccggaagaccaatcccctcatccttaaggagcactggaccgaggagctacagaatgctggtctgcggcccagactaattatcaatgataccgacgatgggatcaacgaaatgtcagcttttgtggcttcgcccatgccgaaggttctagatggatcccaaccgtgcagtatcatctactcatctacctatccgggacaacaacagctcgcattggaagtcgctgaccggctgccgcgatcctgtactgctgccgtggtcgaccttgcagatatctccctcgaccattcagacacagttggtatcgtactggttgggtgccagggccttgatctatcggagctgacctccagcgagtacgacagggttaagtttatcctcacgtcgttccagaagctactgtgggtcacgtgtgatccaactgacgtccccaaatctgcgctggcaactgggctcgttcgaagtacgcgatgggagcgggagcatgataatgttaatatcatattgctgtcagtatcgctatcgcggcctactccactgaccatctcctccgagattgttcgtctttgcgaaaacgcgttcatctcctgcaagcgagtgccgccgaactcggaatatcgcatcgaggggagcaacggtgtcctgctcaccaaccgcctgttcccagcggcgggaattaatgagtgtatcggtttgggctcgcgaccccggtctcgacaggtacctctcggtacggtcgaccaccccatcaagctgacttctatcggatctcagcaaccaaacggatttcacttcatcgaagacccgcaggcgcacgaacctctggaccctgacgaggtaaaaattcggatccatgccgccgggctggatgaggaggacgcagaccaactgagccgactcattcccggtcatggtttcggtgatcagggatcagggaccgttgtggagatcggccatggggtgcagggaatccaggtcggtgatcaagtgatggctttgcgtacgggaccaagttgtgccctacaaaccttcttccgcacccattcagccactgtggccaagatccccgatgggattcgactgtcggatgcagcggcactacccctgccatgggtgacggcgtaccatagcctggtgaccgtggctcgtttggactcgcaagagaaggtcctgatccatcccgcgatcggtgccactggtcaggctgccgtgcaagtcgccagtatgctcggagccacagtctacgcgacagtggagactgatgcacagcggcagacactagcggagtacggggtagaggagagccacatccttgacagtgcttctgttgagaagcagttcggcacgcagacgagcacacagggtgtagatgtgttgctcaacctccgccgcgatggcctagaatttctacacctgtcatgcctctcgccgtttggccgtctagtggatatttcaggttcacgggccttcccctcgcaagtcaactcgccgagcaaccagtcctactatagagtgaacatgcgggaactgtcacagttgaaaccagaatccattcgacaaactctacgcactgtcgcccaactcctcgccagtcccaccattcggcctgtcgcccctttccgagtcggatactcgcaactccaaagggtcctgtccgagattcgacgagggagccgtggcccctgggtcatccagccactccccaatgaccccattccagtaagctctggaccccatgccccatgattccagccagttcgcttcgttaaccagaaaatcgctaggtggcactgaagccactgggcagtcaccaattcgaccccagtgcgtcataccttctcattggagggtttgggggcctcggacggagtgtagctcggtggatgcatcaccggggcgcaaagcacttcatcttcttctcgcggtctggagccagcagtgcggcggctcgggagttgtgtgccgatctgcgggccgcgggatgcgcagtgtccgacatgatttgtgatactaccgatgcacaggccgttgcgaaagctatggcgcagtgtgaggcgtccatgcctcccattcggggctgtctccaggcatccatggttcttgaggtaggtgcatggttcgaataaactaatgtgcgggatgcggttctaacgtggaccgcaggattcgatgctttccaatatggaccacactcgcttcctgggggctatcacacccaaggtgcagggcaccatcaacgtggcctctgccctggcccccatcaagtccaatctggatttctttgtcatgctgtcctcctcggcggggatcgttggcaaccgcggccaggccaactatgcggccgccaacacctttctggatgcctttgcgggtcaactagtgacccagggctacccggccacctctgtcagtctgggcagcgtgctgagtgtgggttgggtggcggagaatcagcataaactccgcatcgcgttcgccttcggggccctttcagaagaccttctactctctatcttggaatatcatatggaccctgcctggggggcggcgcagagcatccagacctgccacacagtggtcggagtacgatctgcgcgggattttcaacgccagtccatccctctgcccggattcatggcccatccgttattctccccgcttctggccattgcaggcaggtcccaaacggccgaacaagcggccgaggctccggtttcgcaagggttacgcgaggcatcatccatggaggcggcggtagaggtcgtgacgcgagccatcgtccacaaactggcgcgcattatggctctgtcggtgcaggagattgatccccagcggtcgctgggctcgtacggggtggattccctggtgacggtggacttgaaggcctggttccaacgggaagtgggggtgtccataggatcgggggagctgttgggggagatggccatgacccagttggcccagcaggcggcagatgcgtcgcaattcttgccggcggagctccggggaaaactaagaaaaaatactgatatacatgtttaagaaaagcgtcgggcaaaatgtgattgcatgattgacgccacgaaagacaagccaggaaacattgaggtatccaggcatctattgtcaacaatcggaggaaaaggcgggccgaggatcaggtgacttgtaccgaggcaggaacgtggcactggccccaaataggcaacgtagcagcgaccttcctttcagggataaacagaatgttgagcagaacgatagcctgtccaaatgattctcaattccatccaatatacacctcccctgttaggatgattgcgggatgggcaataactactaagtactcctaaagaccactcgtcgatggttaaggctttaccctccccgccatgcttatttctgtaatcaggccattatgggcctccttaggggggagcctagactaggaccatctaacagccaacctagacatctagcgtagtggagatacatcgcccagacagtttcgactagccgcaaacatgtgatgtctccggactgaaacccagaagctaggcatccaggtatgattagcgttgttggtccggtagtgtgcttcaatattggctgtcctacgatcggagtccagttaactacagagtacatttatctgacgaaatgcgcagcagagtgaaaaaggccagaatggtgatctcaaagcagcccagaaacattgactaacaggggactgcagaaagaattaagactggcacacgacctcccaccattggcctgtaatacaacggtggatcgaccaacacaccgacgattcgcctcaacacagcttagaccaagcctcttttcccaatgggtagactatagtatactaccataattgtggatcacgatccatctgtggcacatctttgccgcactttggaccgctcagatgccacctgtccgtatattcccgtttccataatagttccatattcctgggcagtgaagtgggcgagagacttgccctcaagccgtgaaataagctttctgttcatgttcgagctgtcctgcgtagaaggacatgccttgtacggagatcagtcaaaccagaggggccacgccgtccacacggtgccccttcgaggaatatgaacggatcctcgagaagaaccccatcttggccccgactggctgtacagaccaattctgccaagctggacgtctcatccacagcgatgagccaaaagtcggggagaatcgtccccttgaagtggtgcagaatgaagcagtggcatttctctggcagctgtggcaggatggcgtgtacactgaggattgttacctagaaaggcgcacacaagttctggaggaaatcgctcggtcggcgaagcaaacaatcgtctgggagcaggagtccaagcgagtggacacgacctcgatctggacacagagccccgaagaacttcgttatggactgcgactggcctggaggaactcgcgcaagtgcatcatgcgctcccggtatcaagacctggaactgtgtgacctgcgacatattcataccagcgtcggaatggccacagcacttcttggggaagtcacgaaggccttcaaccatggccagattaagccgacaggtaggatcaattcagtataattttgccactgtatcgtatagtgatctgaaacgtcttctccagtgtttgtctttccgccgaagtctgtggatggcagtggtccgatgttttggaacaaacaggtgctgaacttcgctggtgtacgttctccttccctctctcccctggcgatgactattagtgctgatgtgaccggatttcgcaaccggcagtacgagctcgaagatggctctattctgggtgacccgagtaatgtcaagctgacccaagacattattgacttgggctggacgccgccacgggccaagacccgatgggatcttctaccaattgttgccatggctgaaaacgacgcaccagctcttgtggaggtgccagacgccctccgtcggttgatcgagatccaacatccggactacccggaattcaatgaattaggccttaggtggtaccaattcccagctctgagtcgattgggttttgatataggtggagttcagtatacggcaacgccatttatcggatggtactatccttctcttcatgatcggtttatgactatggctgaccctgacaaggtacatggatgcggagatcggagtgcgtaacctggccgacacgttccgcttcgacgccctgcccgaggtggtcaaagccattgggtttgacatcgacgcctatcgtgcaaagtcggagtacgcggaagttcaagaactggaggatctgccggactatgagcagctgcggtggcagagccgcgcccaggccgagctaaattacgccgtgcgttggtccttcctgcaacagggtgttacttgtgtgggaacgttggctgcgtcctcggactggtgtcagtttgacgatgaacatgccgcgaagaagggctaccgactaaactcggatccctactggctgtcaccgccacagggatcgattgtgcctgtgtggcatcggggtggtgccccgaactaccagccgaagcctatgatctgtcggaatcgctatgatcccgttaactcgtggcagcgtaggaagggttccacggatgcggatccagtccttctgataaggaaagggaatgaatgggtcaccgaacctctgactggtttcctcgctgatatcccaagccgaaagaggcgtaagctgaccgagtctcaaggggaagagaagccctccacggtgcatatctattactgcagccagggtcccacagcacggactctagctgaaagactacatcggcgagtgaagcgcaatgccagaggacttcacgtgacatttggttctttgaacgccttggacttgactcagatcgaagcatccgatatcatccttctagttgcgtctaccaccggcagtggtgcctttcctgccaatggagctgactttgcgaaggcgatgggacatttttgcgagtctctcaaggccgacttctcgcgtgtccgactgtctgtctttggtgttggggatagcgcctatcccaacttcaatgctgcagcaatcaccgcgtacaacctttttcaccagctcaacgtcttgcccatagctggtggattgattaaggccgatgtggcatctgagacgctgccgttgcgcatgttcaatcattggtcggacgcggtggagtccgcgttagtcggagggaaaggcgagttgagcagcgatcccgaagaatcgttcgtgtcacacgctgagatgctgcgcaactttggccgggctacggtcatctctaaaacatgcagcggcgcagatgatggcttaatcaccctgacacttgacggcatcgagtgtgccgacatggcccacctgaggctgctccccacgaattccgcatctcatgtcgctcgagccatcactgccctgggaatctcagatcctcagcttctcatgccgttctccagcggggcactccagcagtgcagctatggcatcttcttcaccaggttcgtcgatctggaggatagaggtaaactacccagctgggcaatcgagtcgaacaataacagtgggcgcgagaaagaaagtatccttgaaagactggagcaattgtcagtcagtctacagccatcacatttgtctcttgagctccgtcataaaatctgctttggttgcccactccttcgcccccgagccttttccgtggcatcatcctcgcgatacatcggcgagaagaaggtggagctcttgattaagccacaccggcgaggccgattcagcgatatctacctctccacccttcagcctggcggatcagtcgaatatgccatcgttcctgcctcccctgcatcttttcttcccgctgtccaaaagcccctcgtcgtcatcagcactggctctggatttgcaccagtccgcagtctacttcagcagcgcattcagattgcacgagaatggggagaagagagtagcacgctacatccgtttcatacttctcccattagccttttcgcagggtttcggctagaggatgagagcatcattcacgcagcagtcgacctggcggagaggtatcgtctgttggatctggcctgtctcgttcctagtaaccccgaaaagaaacgagttcaaggctatctgctggagaaacgtgacacaatccgggcgaagttggtggaacaggaaggatatgtctatgtttgtgggagtgccgctatgactgaaggggtgcgagccaacttcagcgagattctcgtgggagaggtgaagcagatcatgggagaacgatacgtggaggaagtgttttgagggggcgaaacactaacttccgctagaataaacagtgctcacatcaatcaaactcctccatcatattgctccccctcgtccaggcgcccatgtcaaggcgtagaaccatctgcagtctcaggattgtcaccatcattatatcctctcttggctctgcacaaaactcccggtgcaaagtaatagtacataccgtacgtgaaatgagtcgagacgtcataccgtttgcatgcgaggtaattttgccaagtaaccgatatccacatagaagcaaacgcataccaaccgactgaaaaccaaataacccagccaaacattggaaagagtgacaccatagtcctcgcatggattttgtattgtgctatgctgattggtgtaggccaaccgggatgcgtaccgaaagggtccggagatatacatatgactgccaaaggctggaggaactcatacttatacaatgcccagaaaggcacccgatcaatcgttggggcccatcggcagcaaggtagacacagtgggtgccgagggagacgaggccagtttgtttgcctgattgccagcgggatgaggatatagacattccgataggatgtcagggagtgcaggttcanggatattggttcatgaaatgcgagtcccgagacagctgcggggtatttatctggaggctcggtcagcctcttatctgttctcatcgttcttaactttctctgtggtatggcccgccagtagttaatggattctattcgctggtctctctttgtgcattactgtatctgcttgggcagctaaatnccactaaaaactaccatagctgtctctggcaccattatacttacaacatttgggtttgagactaccccatatgaacacactcagttcaatccattcttaatgcaaaacttatcgtactccaatctcctgcaataaatacactttgtgcataatggcattgactcagcatgtctccctcctatatgtcatgataaagactgcgggtaggacctatcggcaagggggcagtatatgtcaggaagggggtgtgcccatttttagttgggtcccaaaacccattcattctcctcacggtggtgttaattctaccatcgtaatggcgctaggccggggaacggccgccgtctcttgggtcggcacaagtatcccgttagcatcaaccgcccagacctgcacttcgttgctcacagaaaccgcgacgtagaaaaagcggccatcgggactaaatgtgcaacccttgggcgaaatcccattgatattggcagtctgaatgcggcgtaggcgaccggacacctcgtctacggcaaaagcactgacaacgttgtggccgcgaacgagtgtgtagacatattttccggtgggatggacacggagatccgacagcaagacaccggaacccccgttcaggttctctggaagaacgtccactgttcctaaagattcatagtcaccgcccaccctgtaaaggaatgcctcaattactggtcgatactcaaaattgacgtagaaaacgggcagcgtggggtggaaggctgagtaccgtgggccactgccatgcgggacgtcacgaataccctgcaggtgtagtgaatgtaagccataatcaattgtcatcgtaacaagctggtctttctccatgtcacactcgatgagaaaggatccatcgggtgatagtgagacagaatgcaggcatgagggcttgctctgatgacccgaggttgtatggaagtggacatgggatggctgatccgagcaaccggtggcatcgagagtgaataggactgttgtggcatcgtcgtaacggcactcgatgtgataccctgactgggcatcaccggcgatggtggtgatgccggtccgactcgtgaaatgggaaacaattaccatatcttcggtatcgacgagagcgattcccgatggttgggtgccatagctgggccagtgacctcgctcagtcaagccgccagttgatgggtccattgagaaggcataaatctggccaccattcggtacttcgtccgtgacgtacagcatgccacgtttgtagtcaatggcgaaactgccgacgttcagcccggggacgtatgatgccaccaatgtgagtgctcccgtgccattgtcaactcggaaaacatgtaggccctcatgctttcccggttgaggcatcacgaagctgccgatgtacacataggttgcggtggttgaagacacagtatccattttcggaagtcctaggagaacgtaagtccaagagccgtggacagcgtgacgcagctgagattgttttaatacccacaaaataagttttactaccttcatattatttctggaaagactgatcgacacctgacattacgactgctcagggtaggcgagacgagcaagggatgcctttcctaaggtcggctaccggaaaccctcgccgcagactctggcctttaccgagcctcacctggcggcacattcatggaagacagacaccatgggtaacagtctgcgtgtggctgcacgtatggcatgataccccactagcgatcatccttcagcgcaaattaggaaatatggattataactaccccgcgaattccccgcaatctggggaagattggagagatgaccctagttgcatctccactttgccgatcctcgcattccacagctcactctaacatggagacgaatcctcctctgaatatcaagactgatggcagacctaaccagcatgaagcgatgttgttagagcgtgcgcatgctgccaatgccgctgaccatgctctcacctggtggaaagcaatattcaagtaccggaaagccgtcttctgggcgtgcattttttcgttcaccctgactatgcaatcagctgatgcgacttcagtgagtttgattatagtgcgaggaaggccttgttaggtggggtgctgaccaaaaacaagacaacatctttctacggccagacccagttcaaagagaggtttggcaccgtggacaatggtgtccttgaaatatcagccgagtggcaaacgggaatccagcaggcaatggccgtgggcgagctgatcggtcttgcagtggctggctttatggctgaccgatttggttggaagccaatcctcagtggcatgatggtctggcttaccggcagtctcttcctttttgcctttgcacaaaacctggggatgatggtagctgccatggttctttgcggtgatttttgatccttctactccgttgcaaagagattaacggccaagttagggatcccgtggggcgcttttcaaacaggttgcattgcctactcttccgagatggtcccaacttgtcttcgccctttcgtcacggcgtggataggcatttgctggggacttggcttctttattggctcattggtcaacagaggctgcctgaacctgatcggccagtggggtaagtatcccctactattattcaatcaattggagcttccagtgacacagatttaacttagcctggcgtgtgcccttccttgttcagtttgtgtggccccttcccctcctcatctgcttccttttggccccggaatctccatactatctagttcgcaggggtcgctatgaggacgctcgcacgaccctgcgccgcatccggcaaaaggatataacggacgaggagattgagcagtccatcgccctcattgactataccaacaagatggaagttcaaatcaaagattctagtagctacgcagagtgcttccggggcaaaaatcgatggcggacagagattgtaagtggcgatcggtatgctgaagtacttcaagagatgttcacaatcaaaaggtctgtatagttcagatagcccaaacctggggcggcaatggcatcaatgtacagacggttcagtttttggagcaggcaggcctttcagagcagggcgccttcgatctgaatttgattctcaactctcagtacctcacatttggcctgttctgcatttggctgatgacgaagtttgggcgagcaactatcttcaccacaggcctcatcctaagtgacgtgttcttgtttgccatagggattcttggttgtgtcgaacaaagcacggctgtctctaatgcggttggttcgcttctcctcgtgtccactgtaatatatatttcaaccgtcgctccgtcttcatacaccatcatcgtgagtcgcgcagatacacatttagggacgagtggtgacataaaacagggcgaagtgccgtcgggcaaactccgagctaaaatggtctccctcgcccgagttgccttcaatgtctccagtctgatttcaaatgttctacttcccaagatgctgaccggtgggtcttggaatctcggcgctaagacagcctttatgtttgttagtgtccttacccctgacctttctcctgctgattcccgctgatgtgggtgataaaggccggtacgaacgctttgatttggatctggtgcatattccgtcttcccgagaccaaagatcgaaccttccgtgaaattgattacctttttgaggagtctgggctacaccctcgccagtggcgtacggctaggattgatgttttcgatgatgataacaatggcccgagccttgttgtgggcaataaagagaaggaaattcagcatatcgagaatgctctgtaggtaagaagggcggcaaaggacacttaaatgaacatgtgattaggggtgagaggatggtaacttgtggataggaatgatgtcaatttgtgattctccgcatcagtgtctgcagtagtgagcttggtgtacgcagggaagtcagaattggacattaggcataacagccgtaatcatacttagttatgatccaacaaagtcacgcgattacactatattcgtctttttaagctggaacgaatgttatcacattctgtgatactagcgcccaacgatgacaattttatacatacctttcatattaatgttgcttcatacatttctatagcatatgcaaaggcgtcagctatgttttattgtctaatggaaggcaatttgtcttcttaaatataaccccttttcaatgacgagttacggcttacagctgtaactatctgatcagcaagcggagttggtgacgttatatgttcgtaaagccgcgagcaacacctatggagaactcagttgaatgtatcaattatatagactattcatattaacaaatttgtctacccgggctcggtagtaagtcctacgtgcgctaggctatataatttgcggataactgcgtctaccaggccttctgagatcgaacatagcttgtccagaactgttcgttttctgggtccgtggttcgtattgtctgccactccccacctagctccaacaaagtgtgggggtggtcattgaggtttggccagcaagcaacgccttctggacccttattctccccaggaggaccgtttggattgccgtgcttgacaaagttggcccaaagcgtggacaccttttcgccgacaatgcgatcggtgttgctccagggtcggaggttattggtagtgaggctgttgaatgtgtatgcaaattccgcaccatgataagcccccgtaacagggcctttctggtttgtaaatccaggaacctttggctgcgagtaatctggctgccagttgttccagggggggatgggatgggtgaagtagtacccgtacacgggcgaggctgttttctgatgatactcctgggcccagagcgcaatattgttgcgcgtgttatcccgagcagccctgttccacgcgtccagaggacccttcccggtttcatggtctgtgggggtgtagagttcatggaatcgtttcacccacttcgagtccccttgaccgtatgtcgaatgcggtccaaaacgactctcaacacattcaacaaagtcatcgtacgtgaagcggggctcattgtaggtaccgccctcttcgctgttcatgccagctaggatcgggacgtcattagacggacactctgccagcatctggtgccagggctttgggatgacatgtccatcgagggtcaaccgaaatagtggcggggggccccagcagcgatgatctcttctggtggacaactcgcacagcttgtctatgtcattgaattcccggagctcttcgattgactgcaaccccagctccctgagcagctgcacgccatcctcctctgcctgctgtagggtacgatatgacatgggtccattagccacggccggctcctgaagtgaccgaggtccggactgcagaataacaccatgaaggagattcctcgccagaggcgacacaagtagggtgtgacacatggcattacctgccgactgtcctcctatcgtcacttggttgggatttcccccaaatgctgcaatattggactgcacccagcgaagcacctcgatcgcatcgagcatgcccatcattccggacgtgcctgacgcggactcggcgctcagttctggatgggcgtaatagccgaagatggctagtagtttgaacgtcagcactcgcgtataacttccttatcccaagaaatattcatgcgtgcacttacaaagtcggaatgaagggaccacaacaataaggcccttctttgctagagccgtgccatcaaagttaggatcggcactgccaccctcccgaaagccacctccatggaaccagacgaacacaggatatggcttctcatgcgcttcaccgggctggaacacgttgaggtagagacaatcctcagactgtggatgaccttggagaacattgatccagcgggggtcagggggtgcctgtggacagatgggtccgatctgatggcattgcttgaccccatcccatggaagtacaggctgtggaggctggaatcgacggggcccagtgggcggagcggcataggggatcccgaggtagagggtgattgaggcatccacgtcacttgtcttgccctcaatcagccctccattgacgacaactggcggcaacgaggaagtcatgttcatgtatgtattcctatcctaagggaagcgcagtgatagtaaaacaataaagacccggcttgtacctttgacgccgtcgtctgacggaaactacacctaggaagccccgtaataaaagtaaagtgggattgtctactgagccagacgctcggacgcactgaccggttccgaatcgccagaccaagctttgatgtcccccggactaattcccccgcacttgatcggatcttataaagcttcagccgacgctcgcctctgccatgtttcaacatgtgttcgtcccctcccctctcttagtcgggcaacggtaaacaagctgaactcactcgcctgcttcccgttcacaccaaatcccattcagagcctgtattttgtacaccagcaggtgagagagccgtctgtcagctgccgctggtcacgctaatgcaactcaacgagacctccgatcctgtttccgatacttctgtgcgagtcatgccagagccatcccagaagcgaaagcgggccaagaccggtacgtttctcgctacagacctgagcatgacccaggcggccactgatccaccagtttatgtcgcacccaggttgcttgacctgtcgtgcccgcaaagtcaagtgcgacgagacgcggccgcggtgcaatcactgccgcaacctcggggtggagtgccgttggcccgaacccgcaacgaagcgtttctgtcgcatctcaacgccgccttcctgcaacactcagggccctcaatcgatcgccacgggagggccccgattgtctgcatgcttcccttgtcgttatgcccgctcgaaatgctccaaagatcgaccgacgtgcgcccgctgccgttctcacggacacgaatgcaagtatcccgagccccaggggtcccacgccctcacgtcctcggcgcagtcctggatgaggagactccaaacggcggagatgggcaactccgccgaactctcgcgtccggagatcctcaccagcctcactagctcaccagagccggagtctgcaccaacacatcccgagataactgatgatcaacggccggaaatgccggcaggcgatgccagtcccccagagacgtctgataggctggatgatgttgtctccgctctttgtgagagccagtcatctccaacacaagctgcagcaggtgcagtggtgacactgagcccgcgcaggagctttcttcccagccaagatagtattgagcgtcttgcggtcgccttcttccgacacgttcacgtctaccgtgccaacgccttcctgcatcgggatcagaccctgatggccatccgtgacggcacattctgtgtcccggtcgtcctggccctgtgtgctgtcggggcgcgtttcacctctccgccccagccagacgacgtggtcatcagctgggccaccgaagcggccaactgggtcacaacagcgaccgaggtctcacgagaccacgttgtggtcgcccttttgcttgctatctacatgcagcaagctggtcgatttgcccaatctcacctgtggtcggccattgccaatacccacgccgtcagtctgggtcttcatcgcgaatccgcacccggcacgtcttcttttgtggaaagtgaacgcgaccggcgcctgtttttcgcctgctatgccattagccgtttcatatccaatggcgctcccgagtcaatccaatgccctgcatctcgtatcaagttgcggctgccatgcgacggctttaattaccgccttgacgtgagcatcgagacgccttatgcgaccctcgaggcagacgagccagagccgcccggcccaaacggcatgcagcgaaacgttggcgccatgggattttgggtgcgactggttagcgtgaggatgaaaattaagcgctacttccattccatgacggaggacagggaagaacgacacgcacatcagcaacccagtgccattggcacgacacttgccccatggggcgcttcctccccattcgtggtgtgcttggcacagttggcctccctatccgagtctttgcccccccggcttcagctctcccccgagttggtgcttcgacagcacgatgctcctgttttgggccagattgtcatgttctacctctggtggaatgaatgccaccttgagctttatagcatcgctcttcacggatatccccagtccctagattctaccgtcatgtcaaccgcgccagctggctggattgaccaggcccgtcataactgcttgcggcacgcccaggctatcacggatattttagaccttgtggatcgggaaatgcctcgccagccgctgaccatctcggatcacaccattgcgcacgtggtttatttgtccgtgcgggtgcaattagagctcctgatgccgacactcaaggatagcgggatgcgtcttgaattaaagaaaagattcgacataatgctgggctttgtagaaaggacaagtaaatatttccatcaggtgtccctggtcgtaagtgcttccccacgcttctgctgtcaggtgttgagaaggcgccgtaaaaaacctgacgctttacatgccccagctccacgagatgcgccgtatgttggcagggccatgagcttgcctcaggaaccttcgagggcgaggatgcgtaagtcaggcaatcacgtctgcccagtcgtcttcgacccctccccccctccccccggtctagacagcatctaatactgtgccactgctgatggttcgattagattatctcagacagcatctttgccttggttctgccgtcaaaaagcacttgattccagaagagctgccgagcaagctggtatagtgagtctcagctcctcctgcctgaaaaaaggcccgaggctttgctaactcgtgggacgcgtatctctctatcagagcgcagcgcatttcgaagcaaatctcgccgaacttctgcctgattgcatcccacttggcactatgtcctggatccggggctacggcgtcaatgacccttgccgacttgtaggtgcccctgacttgaaaggagctctgctgctgcacctgatctccttattgacaaatttgcctctgtctgtctagcccgaaacagcagaatcatcatgggatattttgcccaatctgtggatgggagccccgcccacggggcaaagcactaacaaccctgttacagccatgagtgattttagcagcctcggtatcttcaatacctggggacggatagaccccaacgggactgtgagtttcctcccattaacatgtgttacgctgcaggcgacaggaagagctgatgacatcagcaggggtctcgttttgatccactgcttcctagtcactctttcgcgcatccaagtgcaacgggaacctgtggaacttcaacagtaatttcttcggacgctcccttttctttgaacccattgaacacgtaggcaattctggacattcaagcgtggatctagcagcatgtgggatctcattcaaattagaagctctctctctgggaattgctttgttttgtttgcatggaagacctgattgacggagggtttctatggtgatgtggaaaagcacccttgcacctcagtaggtcccttctggggggcgtcgtcacacttagtagcgattaaggtctcgacaaatgcaataccattgattcttaaatctctctatctactttgacaatattcccattcttgtatgtaaatggtagaggcaaattcccgcggtcatagtttccatttgggtggtcataatgagtaacagttgctacaaccggcactggcgcatagaccagagaataagcagcctgtccgaaagggtaccatcgtctaaatcctgtatgacttatatacccattcagggactcgggtattaaggggcaaagcttgcattggagccgacatgaagtaaaccgtgacgtcagctggcgacggtcgcctctggttctcttctagattggacggtgaatctgcattgaagctcaatcgtagcctcttcagtctcgctgctggttgaagtagcgtttatatagttcttttctactaatgctagccggcagaggaaaatgggttgaagggtgatcagttccccttgagactatggcaagcgaccggaagtcaaccacagtgataaccgccccaggcaactgtgacagccttgggatacaccctcatccgtcacctactgactatgatgtgactgttgtgcttggccctgttgcgtcaacatacgacaagagctcttcagacgaaaatcatgccgacggcgacaaccacatgcagggccggcattcggtgacaaaagggacaggcaaagaacttcagacgcaaacaaacctacttcccatgaagcagttgcttgtggtcttctctgggctatcagtagcgatgctatgtgagtgaataccgctccaacctagggatgtcggcgagctcacctgactgacttgtacataatttccacaggctcgatgctcaaccagactatgtacgtttgttacatccctcccatatccgggtatttgtttttcccgccctaacttacggactctctgaagcgttgcaactgccctgcccacccttggtgctgtattcaatcaagctgatatcgtttcctgggttggtacagcgtacctcctaacttgtacggcatgtcaaccactatatggccggttgacggacatctttggccggaaggtaagtctcccaaatgcgggaactaagcagtcctatcacttatgcagcatttgacggagcattaaacttcaggtgattctcttgggctcgctcttccttttcctgataggaagtgtcatttccggtgtctcgaggggcatgaccatgctgatcatagcgcgtgagtcatggtaactgaattgatctcgccggcctccacgctaataccattcaaactcaggggcggtagcgggaatcggtggtggaggcattgttaccgtggtcagtatcgtcgtgtctgacgtcgtgtctcttcaggacagagggaagtaccaaggaattattggaatcgtcgtggcagccggaactgccctgggccctttgattggcggtcttttcaccgagaagatttcctggaggtggtgttttgtacgttctctccggcatacctgttttggatgaccatcgctaagcgttaccagtacatcagtgtgcccttatccggggttgctatggtcgttgttgcctttgccctacccctccggaaggttgaaggccatgcgttagagaagatcaagcagattgacggctggggatgtttgatcagtttctctgcgtcaattgcgatcttgcttcccatctcatggtatgcccaacagttcttccacccaccctcagtatggttcctcccggggtataataaccactcgcaatttattagggctggcacccagtattcttggacttcggcggctgttatagcgccgcttttactcggtgtagcgctcattggagtctttctctttgtcgagttcaaagtggccaggttgcccttgtaagttatgccttggttaacgaagatcaccagttattgcgtgtaacactgacccttccctgcaggattccacgttagtactcgccgcctcttctaccatcgttcgccgttgttcttgcatggctgatctcttctcagtgcatatgttcaaaaactcgcacgtctccatctgtatcctgacatccttcctcaccggattcatgacttttgttaacctctactatgttgggtttcccccaggtcttcttctatgtttccatctcatactaacatcccgcctcagctgcctcagttttatcaagtcgcccggggcgactccgcgctccggtcgggtatcctgattcttccacttatcctctcgcagattgtcacatcatttacctcgggcttcctggtgtcgaagtattcatgttatcgaatcaacctaattgtcggttatgctctttggacaattgcgtcggggttgttcacgatggtcactccatcaacgtcggcagcggtactggtggtcttccagctactgacggggctcggcagtgggcagacacttcagacaaccttggttgctattcaagccgcagtcaagagggaagagatggcggttatcactggtgctcgtaattatctacgaatgatgggctcgactttggctgttgcagccagtgcggctattgtcaacaacattgtccggtgagtgaaaattcatttgcgtttacccgagcatcactgcctagcttttctggttttctttctcccttagcacttcgctcccaggtaagctttgttgacagggtttgataggacgaagctcgaagcaatcaactttccgcgatcaatcatttccgaaatcatcgccgatcccacaaaaattgcctccatgtcactatccgcggcacaaaaaacggacgcactaaatgcgtacggtgcgttgcccctcacctccatcgtgctttacccaccttcttcatttacatcctaaccaaccatatgtccaacgtcttctgtttggcggaccggctcaatgactaattctttgctgagacagcccacggagtgcaggtcacatattatatgatgactgccctagccggcattcaattctttctctgcgttttcttcgtcaaggactacacattgaagagagacgatgatcaacagaaaaaggaggctgctagagcttggctgatgcaaaaaaagaacaagagggcgggcggtaaccacaatgcagaaccatcacctgctgaagcccgacagcacgttgaggacaaggtctaaagttactagggatatatgccagcgaatagtattctgtccagggcgctgttttcctgaaagcatctaaaataattctatagttgggttctacgacgtaatacttgtcaaatcaagtgacattttgaaccatttcattctatcatctttccggttaagaattggagtacctttatgttattaccgcaatcaaaaaccaacatgcttgttttttgacgtaaacagttcatatagctctaaacttaacaaatgatttgatgcagttatatctgatgatgttactaattaaaagtacgtagcctgatgcgctgatcaccgacagtgtcacggaggaaatcctcgtacgacttgcacgcgacaacaaagtggtattgcatgacatgcttcattcatagtgaagtgcttctaaatgcttgtagacgataaggtagtataatttcaagactaaggtactatactactcaaaatagaagggcccagcacgccctaggatcaggcctcaataacctttgcccgtgcgttccaccagaactggagaccttcgttgttcaggccgcccaggacatgctctgcggtgtggggagctcccgggacaatagctttcatatatggcacgcccagagcatccaagctggtccacatgtgctcgtgtgcttcacgtagtctaatgtcctcgccgccaatgagcagccgcagctccggcttgtcgcgatggacccgagggaggatggccttcagcagcgtgagagcatgattagaagtgaaaaaggcctgcgagccgttgtaagtgtcgtaggtgacctcgaggccttccttggctaattcggttcggaatgagccagcaagcgacgacaaggcgcctccgaaaacatcgggatacttgagaccgaggttgaaggcaccataactggtcaactgtctttagtaaaagaaacgttctacgggtgttcagccacctacccgcccgctgagtgaccctctagccaacgtgctgatggatgtctaatggtcctgtaccgctcatcaatagctgtgacgagatcatggcgcatgatgtccccaaggcggcggctgccgtcgtagctgttgatccagcggccttttggcaatgactatgaacggtatcagcaagggtatggataacaataatctctttcctccaattacgccactccaaacgtacctgcggtgccaccagaattaccttgggcatggtgcccagctccattttgcgtgcatagaattggagggaccacatcgcatggcgcgagcatgaaaagcccccatgaagccagtatagtacggggtatcgctcgccgtttacatcacgatcatcgtagcccggtggtaggacgaccagataggaaccctgcgctccaggaccgcgcgttggttggctgtagagctcgtaaataacattttctggaagctcccacacgtctgtgtcaatccacatgtggttgtagcagtccagaaggtgctttggcggagtccaccggcctgtaaaatcgtggtgtaagcttgctcaaccattacatctaaattcctggggcgactcaccaccgtatgcggggatcgggggataaacttcgtctgatttgtcggcaacagtcattttgggtatcctggcctggagaaagctaaatatggtgcattgacttgatgaaccaagcaacaggccttataaatatggtggttgtgatccggggaggataagccgtaacaactaccggagtgcttcgcgaatgtcgcctgtataggcgatgttcgccagttccctttcgacggtcgcgtgcacgtcttggctcgagcgactctactcaatactgcttaagacgttcgttggaaaaaaaaaaaaaaaaaaaaaaagatgagaaaggaatctttcttcatttcctcaattcaaccacaggcccggtttcagcgtcaagaatagcggcgtgagtgtggacaacccattcttgttcgccattcttcggcaaacctttcaccaatccacataccctttcccctcactttatggtggagaagtcacgttgtcgatagccaaaggttccctgggcatgctatagaaagtagtcggtcactcgtcatataagttgttttctcttataactagttccttgatatacttggtgggaggatattatcaggtatatattaagcggtgctactgcggacaccgtcagctggcccaaattgtaggacccagtaaatacattagcttattatgggatacattaaatcattggacatagaatcaggggttttctgtgacgtgatggatgatagtataagaagaaagagtggctgtcagggtatcagactaggacatgagcattttggacacggctcgagagatcagttcgcccgactaatctcatcatcctggtgatgagatggcgcttcaggggcagtagtcgttgttggcggcggcacagtggcttcttgtgggtgcgtgactggggtggaagaaacgatcgccatttcgggatcagcggaagtagaagccggagcagcagcagcagcagcggtgggtgcagaggctgatcctggccgcgattgtggcgccacgctgggcgagggactgggctccaacagtcgaggaccgggattctttgctggctgcttgctagtcttgacccgggcaggtgcaggacccaacaccggcgggtatttgtaccggaatccccagacgaagaagagacgcagcttagtccagaaccccattgccttccaccgcttgcgaaggacctccccatctgcatcggtacgtgctcgataacccttccggaaaaagcatagcagtaacagagtgaaggggagaatggtcagtgaccagcagacggggagaccgcgacgtgtttgccagcccatcatcaggcggcggaaccgaatccacgcttccaggaaacctaaaatcaaccagaggccaatccagccaagtgtcaaaataagggtgagggccaacggggaaatgcccacgtaataatcgtctgtgaaccagttgtaatcgtcgtcatagccgtagtcgccgtagtacgagctgccgctgtagtagccgttcccgttgctgcccgtgtaggcacagctggaagcagtgtacaatgaggtaggccggttgtacaagctcatcgactctagtgagctcgtggggatctgcgtcggatcaacatagacaatgtcgatggtgtaggtcgtgggctgaaaaggcctcgaggaatcgaccgagatcgatgtagcaacagccgtgcgtgggagcagatcctggacctctgtgggcggaacaacctcgacggctgttgtttgggtccagcgagacgagcaaccggtgggcgctgaataagtcatgttgacaacgaacttggtgctgtggtagatatcatcgtcgtcatagccatagccgtaaccatagtcgtaatcatcaaccacggatccgacgcctgtggggtaaagctgttgaatgatagtcacatccttctcggcgtcttcatcgtcgttgtagtagtagtagtagtttgaagagccgagggaggtggcggttgagacggcctcaggcatggacgtgacggtgggagtgatttgctcaacgagagtggtggtgtatgttgcatagtaatgccgttcggtggtgaccacctcctggtagtccgcagtgacaatccatggggcagcagaaacgaaagaagacagttggaacagtagcagaagggagaggacccccgaaaacgaacgtgaggttgccatctcggacggacagccgaggagaatgatggtgaagggagggagcgagggagaatccggacgagggcagtccagagaccgtggtggccatgagtgcttatctataattaccttgaggctcgagcctcatatgactccacgtaggaactggtggaaattgctgcatcttgatagattgcctcctcgggtaattgattggcagggtttcgaaaaagggtccagattagagccttttggagggtttagcgccggcgctaagactcacgcttttttttccttcagaatttcgacagggtccaacagggcagagtttgatccccagtcctctctcgcaattaattttgctcttgaacggctcacaccctttccttttatacgactctacgctcaataactgtccacgaatatcatggactcagacaagagtcgcgttatgttcggacgccttccttttgcgtggcaaaccttgctgggggcgagaactgttagcgccgttgctctcgacacccgatcatgttcgcggtcgcaaagagtctagtccaggccactagatcaaacagacttcgacggcttgttccgctaatcctccagcgttgcctggctggcccctggtgcctaagtctctagctctctcgtgatagtgcccctagtcgagaagtcggatggggttcgtattccttgcggttgaatccactcctcggacaagccacgccgagggttgaaccctgtgctaaaagagcccagccaatggaaagactcaatgcgctgtgttttgtccatgaacagccatgaagctatgcagatatttcatgcctcccgatatgcgtggtcgtctgcctgtgggtaacgaactcgagaattattgagctgccttccatcagaccactcttcctagtcgatgtgaaaactatacagtttcgtcatttctgaggcccttcgccgagggttcctccacgatttttcctcaatatgagtggcgtaacattcgggtaaatagagtccagactatcgcctgcggtctagctattctatcgacgaaccccatcgaaaagacggagcggcaagtcgaatttgccttcagaccatctctccagaacattcatggcttgaatctcaggcccatgttgttcgagggcttaaaacgatgcacccggggatagattcatagagccatgttgtagagagtatctcaataattatcggttacaaaggcatttgtcgaaagtgaagtcacctgaactagtatccattgttgcacgtgtcttttccaaatgcagttgtcacactactactgatccggtgaccgcaaacccttgcacaatgtccaccatagcctcaatgccagcgggacatcgagcggccggtctagaacatcaattccgatagagagcttgacgttggcaaagtgattaatctccgtacacatctcagaagagagactgacagatgtatgtatgtgggactccatatagaggtcctcatctcactgttgtcgaggtccaaatatatttcgctgtcagagatctgagaagacacatccgctgtcacatttgcctcgctggtggtagtaattgccactccaacccgaaacgtgagttctgggctgatgctgagcattctagcaatcttgaatgcagataccgatatggcatgtaaacataaaatcccagagcattataacgtctgttccaccatcctgagctgcgatgcttacatcggcaaagactgctaggtctatctccaggtacaacaaggtcttggcagtgagtttgacgatatcacagttggttttgctcctcaggttatgttcatgcccaaattcacttctgtatgtcgatggtgtagtgggtagacttgatagaattcctgaatcttcaccgtgaaaacgatggccaagtcgtggtttctggcagtcatgattatgcagttgaagactgcaaaaataaaatctgctttattccggatgatgctctcagttgcttctgcggtgatagtctatgagctgttgctatatgtgagagtgctgaccacatatactccctgagtgttttcgctgtcacagtcgcctatgtgattgtgagaatcatattgtgtgatgatggccattcggagatgctatcttcatattcaccttcactactgcaggtgattcctaccgcgtccgttgagcattcggcgcttgtattgaagttgttgtcgccgaggatgacagttggtaatatcatccctgcatttgccgcagctgcggccgagaattggcgccctgttccataatacggggatatgttgcgttctggcattatactacccagcaccgtttctttcctacaggtaatgggatacagcgtccgggtttcggctgtggaagccatggtcagtggaagagtgactgagatctcaaaatgcgatgccatattggcaggttttatttttacgctatggaggtagctcccttactgatggctgcgagcatctgataatctcgccggtcctttgacaagagagtggtccttgacatatcaacaccaagcatggcgctcggtgcatacgccacggagggcgaatagcattggcttgtgtcggtgctgttttaacatccttagtcctctagaatcatgccagataggccatgttccagggacttttgacattaatggcggccgtggtctcaacccttgcagtcttgggcattaagcttatttagacttgtttgtatggaagactagtgcatgctatggccttcatcgcatcattaacccgcagaaacgtatctgcatcaattggtcgaatcttaaggagagagcacggctagtagatcaggcctcattctgcgctgattcgtcaactcggtggaccttgctgttacgaacttccgcatgtctgcctcatgtaggcaagtagtcagcacgggtggaggggaaatattagcatcacccacttaggaacggctccatgcaagagagcgagcaatgatgcaacctgtattgaggtttctgcatgctggtccttctgtaaggctgatacgacgctgtgatggccgggttcagaacttcaacctgttgaccaattcgtagttcctagagtgcaaacattctttaacataatgaatgtaatgggtattaataaaaatcatattggcgacagtaatcgactgtatgcgacctagagcccctagagccttgagcagatatggattctctaccccctcccttttattgtcttgtacatccacggacttcttatcgccttggagtaacgccttccttatcttcaaaaatcattccttttggcctgggttgggatgtttcagggcagagacttcgcttttagacactaggacactgaattctgtgaccacattgtcttgtgtgacgtgcctgcttgccgggtaaggtttctcccgggaaggtataaaagtcacgagagtggtattatctcgagctaatatcataacttctatctgcaatgcatttggtgttccctaagactcttcagattgatggaagcgctcttttccaacccagcatctttttgctctctaatccagcttgattagtgattgcacaggctgatttttttgtttttgtacactctttccttttctcttgttttctttatacacttttttttttttttttttttttttccctccttcttttcatacttaattgaatttctattcttttcagggctcggttttggtattatgcattgctgggaacgagttggagtttttagaggtgtcagaaatgttgaacttctgctcacactacaatctgtgtaccggatatatatttttagtatagcgcatggaggttggatgattggactcgagtttcttgaagatactaatacgaccagtggtaacctccaagtctgacctagagtgctaatctccctcatatacagttgctactagctctatttacaagaagaattcgaccaactaattcaggctggctactattacctcgttatgccttcatggtgatatttatgtgaccgctcgttttcggtctcgcattcgttccccgtcaattcctgctttaatttcgccggggcgccccactttcgggaagaaaagccggagggccgagaacagcatttctctatgcagaatgaatacatggtattccctgccctgcctgcccatcattccaaactcatatcgcctgatcagattagaggaatatcctgcttcactttatatgcaggaatatcctattttcgtgtccagatgaacatgagaaaaggacaggaaacattcacgagcgggacgagctgacgtaagtccatcgggcaccgcaggctaactagttcaaatagtgctgtgctgctagtgttatgctagacatatatttatgcaataacataaagcgtgatcagggactaagtgagtaagtagtacagctgtacaaaagcattattacaggggatttatgtgtattaatggctgctcacccttttaattggtccgcggatcggagacagccgagtactagtaaattgtctgcattaatatgattttaatctgtcgggtgtccctgacggtcggcatggcttcccatgggtcgtcatgcgatggggctgctgccaattcgtcctcatctcgtcgaaaaattcctcccagcataaaatccggggcatgcccttgattccagttgtagatgtagtccgcttacccctgtttccgtccttttcccctcggcccctccccccctcccctccttccctccatctatctatatcgaggagggccaagatgggtgcatccgatcccatcgccaaccccgacttggaaaagggtcagccgccggcgactgtgcagcccaccgagcgacaccaggacaacatcgtggattatgatggccccgatgacccggaaaacccattcaattggcctcgctggaagaaagggcgccagctagttctaatggcattcaacaccttcatcacgtatgtcttgctgcttttcggtcttggctttatcatatccacttcttccgttcttgggctagatggctaatgctaccacatcagacccttggcttcctccatgttcgcccccggagtggaggatgtgatgatcgattttcactccaccagtaccatgctcgcctccttcgtggtgtctgtctatgtcctaggctatatgatcgggccttttctcatcgccccgctctcggagatttatggtcgggtgtacctctatcatgcatgcaacatcctattccttatcttcaccatcgcctgcgccgtggcccagaccatgccacagctgattgtctttcgtctgctggctggcaccgccggcgtttgccccctcaccatcggctcaggcaccgtggccgacatggtccccaaggaaaagcgcgccggcatcatggccatctgggcgatggggcccatcctcggccccgtggtgggaccggtagctggtggctttctcgccgaagctgaaggctggcgctgggtgttttgggtgattgcgatcgcggtaagtccaaacttccacttccacaatccctcacccgcaaatgcattgactgttttgtccatagaccgcagtgatgagcattctctgcatgatctggtatcgcgaaacatatgccccggtcattctggagcggaaagcggcccggttacgcaaggccacgggcaatcccaacctgcgttcagtccatgaccgtggccaacaggcgcacgagctccttctggtcgcattggctcgcccggttaagctcctcgtcaaatcgcccattgtcctcctcatggtgctctttgccgccatcacctatggctacttgtacctgatgttcaccaccatcacctccatcttcgaggacgtctatcatttctccccgggcgtcgcgggcctggcctacctgggatttggtgtgggctgtctcatcggcctcgtcatctgtggtgccgtttccaatcatattgcgcgcacccattcggccaggggttgttttacccccgaatctcgcctgccgcccatggtcttcggctgttgggccatccccattggcttgttctggtacggctgggcggccaaggcgcaaacgcactggatcgtccccatcttgggcacgggcgtctttgccattggcctgatgaccgtctttatgtcggccagtacctacctggtcgactcctacctccgctacgcggcctcggtgacggcagccaacacgggtctacgatcgctggtcggggccctgttacccttggccggaccttccatgtacgatgccctgggcttgggatggggcaattcccttctcgccttcattgcgctcgtgatgtgcgcgtgtccgctgctcttctggcggtacggggcacgcatccggacgcaccctcgatttcaggtgaagttgtaaaagataccctagacgcatgtagacgaaagcattgatagaataatatacatagaaagtcctattttgccagtattactctgaagttaccattccagctttcttgtacgtatgagatggatgagttcacatatatctacagtgagtggagtgctctgagtgaccctgacaagctgcatcccatgcatagattgctaactgtgggagcggcagctggttcgtatagtcttgttagaaagactttccatcaaccatcttgtaattgagtttgtctagatcacagttctccagcagacgcacctgcatcaattaacaccatttttgggcctttctgtagaccggttcactcacattgactgctataataggaggcgcgtcttctgccaccaaacggatgaaacaactgcttccgcaggtcccacaaaattcatgtttcgcctgacgccggccaaactggtgcgtccgggttgtttcatcgctctccagggtgaaatctttgagagaggggtacaccagcaggtacccattcttgctgcagatagagcagttgcagctgacgactgggtattcggacagtggcggtgacagcgaaaagcggaagcgcacagcaccgcagtggcaactgccttggtgcatgctctgctctgatgttggggtggggaagaaggacatgatgatcggtcggtgggattgggagttagtgactgtcagagggaagttttgctctctgcaactacctcgtcttccaggggatttgggcttccttttgaagggagttatattgtgactcagaccgagaactctagtacaaagtgactaattactcagaaactgagacaatggctgtccaacaaacttcgcacagtaagcaaggccatccccgcagaaatctgacatcagcgcggatgaccgcagctctcccgttaataggctcatgctacgggttttctttgcaccatgacaggctgactattttcagggccctattgattacgttgaatgggcgcttgatggatccttttattttctatagaagtcgcgtattcccacatatattgatccgagattcaccctctctctcccgccggcaatcaagtttttcaggcccctcttataccttaccacacttttgtctattgggttggacgccaaatccggtgatggaatggatacctagtgcttatatgataggagttgaatactacgcatactctcagcctaaatatggcccttgaaacaaactagactatccattgtctggatgcttcacccaaggtcagaatgaaatcatcattatattgaaccccgtacccagatcgacgccgcgtatccacaaagggctgcacgactcgtctggaacaagctatgcatctcaccgttcccccttctaccatcagtcgcgtggtaccaatccgcagggaaatttacactatgtatacgagcaccggggaagagccactgatcacggaaagcgttcggactcggtaaaggcgcacccgtcgacggagctgtcttcggagccaagtccgacgggacttagctaggggaagcgctgtatatgaaataaaagcaccactgcctcaggtccaccaaaacagtctctttcgttgacgataatcatcacttcacaatgtctaactgccctcagtccccccactcgaaccgcacccgcaccatcctccacgccgcaaagaatggcaaatacgccgtcggcgcctacaactggtacccaaccccccgggcagtttatttctcaaccaccccaatactctcccagtactagaactaacgaataaaccaaaagctataataccgacggcatcatggccgtcatccgcgccgccgagcgcatgcgcagccccgccataatccaactcttcccctggaccatgcactttcacggtgcgcacttcatccgcttcgtcgtcgccgctgcacatgccgcttctgtccctgtcgccgtgcatctcgaccactgcattaaccccgaagatattgatctcgccctcactcttccctttgactcgatcatgatcgatgggtcaagcatgaacgaggccgagaatatcgcggtctgcgcgagcactgtcagcaaggcgcatgagcgcggtatgacggttgaggttgagttagggcgcattgagggaggggaggatgggcttcccagcgtggatttaggcagtgtgttaaccaggccaggcgatgcgaggcggttcctggaggcgactcaggcggactttttggcgccgagctttgggaacgtgcatgggggctacggacttgtgggagcggagaaatgttgggatttagacttgtacgctacccttcctttgtctattgtcgtttggttgtatggatgaggaggcactgactgcatcgatcttgtgcaggcttcaacagatccaacaggctatctcgtccaccccgctggtcttgcatggaacgcacccggtctccgacgagctgtttctcaaggccattgagtgcggcatgagcaaggtgaatgtcaaccggacggtgcgcgacaaatacacggagtttgtggcagagaacgcaggcgagctggagttgacgacgctcaaggtgcaggcggtcgaggtgtataccgagtcggtagagagggtgatgaaactgcttggctcggcgggcaaggcttgagtttgctcgagatgcaattgaagacttcggtgtgggtgtagaaggttaggactataacagcgagttctgtgtaattttcggactattcgtaggccccgacggagatttttggctgccgagaatgcatgcattaagtagggtaggtactccgaagcataatcctacgttgggattacccgtactgaagattaacgactataggcgaacatcaaaggaatgaacaccgatagcctgtgaaagatcattatatatctattgtaatctcataatatgtctagcgttcactcgatagccgcctctagacagtaattgaatgtaaatctcacagcaccacgtgactagagctacctaaactcctacctaaatccactggcagatctatcaacgcgcggggaggctgtgtcagctgacgttttacgaacaagaaaagggatattatgctgaccttgctccgtccctcagcgagcccccatacgagaaacttggatgcccaagcgcggaatactagcaatgcaatgatcggatctaaccgatcttttcggtagcggtccgatggagtggcccgcccatcgctgaccgaaggcggggttaatgaccgcagtttgtggatctgggctgcgcatgcttctgaaatactctgatgtagctgcccggcatcggacgctttcgactaatagggactaattgcatacaagcaccatagaattgaaagcctggggagagtcaaaattttcgtaaaccacaaccaccctaactttttaattgaaccagacatgggccccaacggtcagatgggaatagactgccatttggttctttattactctgccatataatcgagtatatatggttggcatgagatagtgtataacatcaataaatttggtcttctttccataactgataatgatagattattcgtatgataaggtactatggtacgttcccaatagctgataacacaatcgtgatcaacttccacatatactactttctataaaagattgtatactccatacattttcagaattgatcaggttttgaacttttttcttgagcttgaagtatgattgaccagatgtctagagattccgaaagattcattgtatgttcccaaaaataatattgctacgggcgtatgaattgtctcttagtcttccatagcttcaccttagtgccagcggataatccgacaggggcagttcggggacctcgtactgctttgcggccttagtgaagagtgtcttctctgcttccatataaggaataccctcagcccgcctctgcagccccaatcggtgctccggctctccaggaaatagcacctccgaaaatccaggcgccggactaaccccgtgcacccgctgcgcaaggatatccattcgagctttgaaatcgtccgtgctcatgatgatatcaggcttgatagcaatgaagcaatggcctacattctgcggcttcgtatccttatactggtccccaacctgtccgccgaactcagctcctgccaaaacgcccgacataatgtccatgagaatcgcgataccggatcccttcggccccccaattggcgccatgctgccgttcaacgccacattcgcgtcggtcgttggattcccatctgcatctagcgcccagcccagcgggatagactcaccacgacgcgcggcgcgtcggatttttcccttggcgacaacagagggcgccatgtcaagaatatacggcacttccgtattagaaggagccccagcggcaaacggggagataccgagaagtgtttcctttcctccgaatggaggcatctgtttggcagaattggtgaagacaagcgagatcatattcgctttaagcgcttggaggacatatgttgctgccatgccgaaatggttagagtggttgactgttaccattccgatgccgtatatctctgcacgcttgatagcttcgtccataccgcgagtggcgacaacgaatccgaaaccgttgtcgccgtccagatgcgcgactaccggggttttctgggtgatattgatgcttggccgggggttgacccggccgttgctgacgcgatcgaggtactgcggaagcctggcaaggccgtgagtgtcctataatgcgtgttaggaggtaccagaagcaaggtagtttacgaatcttacgacaccgcgaacgtcggctaagactaggcattctgccattgaccgcgcgtcctctgccatgaggcctgctttcacgaggagggcggccgcgaaatccttggccttttcgggatcggcataatattgtgactggttagaggaagacattttgggattggagcacgagaaatggttagcctaaatgcccaagctttaggggcttgttgnagtagatttataaagctgccaacgtctgaaggtccgaggatcggatgagggcttggtcggttaaacgccgacgctcaccccactcgtgattttacggtaatacaccggatgggacagagtgcagtaagctgagacctgcattctttacataattctcaatgatagctgtctctaaaatatgtttgaccgtgaaaacaagaacatgtgctcgtcctcgggcgcaacttcgaaatcaaatcgaaccaggtcctccttgtatgggaacatatacgtgcttgtaaccctaaacacaacgaccatattagcagcttcccggacactgacgtagattcccgctcaccagtggtgttccttgcttgcctgatatttttccaagtctgcaagcgactcatggaagctcagaagtgcaaactcgaaccccttacttcgttcaatagggtcggtcacagatggccctcccactaccagtcgatgtcctttcacgcagtccagatctttaagtttcttgagttctctagcgaaggtctctttatgttccgccgttacttcggagcggaacttgaacatcactggcatcaaccaactttgttagctcatgatgaagcgaatcgaattgaaccagtgtacccatatgcacgattgtcattttgctttctttgcagatattatggacgacgctctatgccttgacagatagaatctgagatctcgggtagggttcagccaatactgaagaataataaataaaaatcgaatgtactattacagaagacgcgtcccggtcactgacctctcacgcagtaggagaagatcaccgcatctgttcggcattttgccgttcgccttcgggcccgaacagccccatgcggccgccatggctgctatcagaacacctggctggaattgccgtctatcgtactaagagatatgccaaggctagtataagctggaagtgctgctcaggcgggttgaagtgcgttccccatggggtttggctgcttggcgaccccgtggggaaagggtatacttgataacggttatcccatgtagcgaagcttctgcgacaagggccctttctgacatcgttgcaatcacaaaaataccagaatttctccttacaacccatcccatacgtacgtagttctgtcaccatggagcataaatctgtcgagcacaacgagtttgtcagttcaagcaaagccgatctcgagcctgatcgactgacacctgcccggatactgactcctgagcaatttgccctcgcggagagaaagctcaagcataagttggatttgcgtcttttgctctgtgtgtggatcatcttcgtgatgaactacctggaccgagtaagcgcccccctacctgcgtgcatttgatcgggcctcatgataacacgacaattgtgtcgtagaacaatatatcagccgcgaaggtagccggaattgaggactctcttagcctaagcagcacgcagtatgctacggccgtggctctgcttttcgctggctacgtgctcatgcagcttccatccaatattttcctggcccacctacgcccctcgctctacattccatccgttatgatcatctggggcatgctatctgcgctggtaggagtcgtccacaacccagccggtttgtacgctctccgatttctgcttgggtttgttgaggcagcattttatcgtaagattcccaccttctcccgggtgacactcctgacatgacctcaacagccggcgcgctcttcctaatttcatcttggtataagcgctctgaaatgggagtccgcagcgctttccttttctccggctctcagctgggaagcgcattttccggcctcatcggtgccggcattacaagcggcctagatgggacccgaggcctcgagtcctggcgctggatcttcatcatcgagggctcagcaaccgttttcattgctctcatggccctattcgtcctcccaaactacccctcaaataccccttggctaagcccagaagagcgcgccgtcgccgaatggcgcttaattgaggatgccggacaggtcgacgaagatgatgaacgctggagctacgggttcaagatggcgttcagcgactggcggctgtacaccttcgcgctaatcttcctctgcatccaggttgcgagtgcgacgtctaacttctttcccgccgtcgttaagacgttagggtttggcaccgtcaataccttgctgcttactgtgccgccgtacctggtagccctagtagtctccatcgctaataattggtctgccgatcgccttcgcaactcgtcgtttcacgctatctggcccttatccattgcgattgtcgggtttgttgttgcggccgctacgcttaacacaggcgcgaggtatttcgccatgatccttatggtagccggggggcacggctccaacgccgtcgtgctggcctggacacaaaagaccatgcttcggcctaggatcaagcgggcctcggctgtggcgtttgttaatgcctttgggaacctttcgcaagtatgtgcctacttccttaatttcgacgagcaaagtaagtaaagggcttaccatgccaatggtgcttttgcagattttctcttcgtacttctaccccgataactctgctccgcggtacgtgaccgccatggcggcgaactcagctttttccctcggcgcgattttgctagctattttcatgcgatttgttcttcttcgcgctaatcggcgcattgagagaggtgaatcgaccgtgacggaggagatgagaggtcaaagtcagcgggaaattgctggtgtctctgatgaggagcgcgttgcaagaagggaggggtttcgatacattgcttagcctacgtaacacctcgtgtatcctgaaaggtggtggagtcgtgactgttccaccctttctctgctgctttgtaggcactgccctctggcattgggatgtttgctgcttgacgcgtttgatcctgatttaccactgtccatcgagaggtataacttgaagcgatcgagttactacactaatgaagatagtgaacgggatatatcagatttaattctccttttctaaagctgcctcttcatacacagatatactatcgggcgcgaggaactggatagccaagccatagcagccgagccttctgttactattccaccccctaccgctttctaaagaccttaaaaacatcctctacacttctacccgccctaatcccctctgcacacttccgatcagcctccacaatctctggaataacatcaagcaccttctcaaccacctctcttggcacccgcacaaccccattcaaatccgccactatataatcttccgggttgatccaagcttcctggtgctcagagtgcagccggacggggacgttaacttcagaaggccgacagactgccccgccagctgtcgtgccgagcgatctggcgaacagctacaccatttaataatgcttgttaacatagttgttaagccatagagttgacctggttccaagtatgacttgtggggaggaaggagatatatgacatacagcaaatttgagcgccctgtgctctcccaaatcccgtacacgtccgtcaatcaccacccccgctgcacctagagcctgtgcccgcagcgtcatgagcccgccgtagacagcgtttacctgtggcagcggttgggatatcacgattacagccccgggtgggaccatatcaatctacaacataatcatcagccagccaaaccacggctgtaaacttgagtgctcaggcaggcatgtcacgtacatagttcccactcagcttcggcgcggcttcgtcatctttgggcacaaatttaacggtgaatgcttggccaacgatctttgtctctccggcttggtattcaggtgaatagagagtgagaccttcaagaaagccgccgtgtgggtgtttgagtttgctgaggccgtcagcaacctagggcatattagcagtgaccatgagctggtcaacaagtaccattgtgtggggtctgtggatgggtggtcttacgtcacaagcgccccattgcttgagacgctcgataatctcctgtggctcggcggtagcagtcattgtaaaggcgcatccgatagctgttggatcaactgtttcgttgaggtggctgatccggattttattccctttatgcaattcgccgccgtcgtgagggggcgatatcggcggtttcggctgatcggacgcgcttcgggggcttgccgtctctggggagagactcggtttttgcggaccccatgggtgtgcatttatggacgtattaaggaaataatagacggtccagctggccgaggttcaaaggactatatataatatacacaatagcaagcactgattaacgttacagaaaggacagtatcaccactctggcaacatgctcatccaccacgacgagctgcaccagaatcccgccgagcatcaaagcccgtcataaaccccgaggtatcccagacaggcggctgggtaggatccgagccccagtcactgagccagccgaggtcaaacagatcgcgcaggatacccaattcatcgatcaacagcgacctgccgtcttcttgaggcacggcgctagccccattcccaacctgtgtctcagcggtcggatttcttatattgttatccgtagtctcggattgccttgggttctcggcggtctcggaaatactttcgcgagtcagggcaatgagtcgcgagagcttttcgcatggctgcactgctacagaccattgccgtttaaggaatgtaaggagctccaaggcggactctacacgggataatggaacgtttaccggcatcagacctctcaccgtagggtaagcccagaggcaatacagcactgtgatggcagcaacaaagatagagtgagcagagagccacgacaactccatgttcaagaagcggtgaagctccgcgttgatctggattatcttcattgcgctaccaaaacatgttttgatggcatcgaagcttggatatggcaactgagggctcggtcggtagaggagtatgatgcattggtggaatttgatctccaggcattgcacggttgttccagatagtgagctgcggccgcacagcggacggccgcgctgctgattgtggacttcggttaggaggttattgcaagcttgttctgtctcccgttgccaggcgggaatattcgatggccagggaaaacgacgtggcgagcgagagacgcggtaaatcattagcttgatctcagcaatgattcggtcaaatcgtagggagtaaataaatgctagatacgtcgagggtatttgctcggagggctgcatgttcatttccgacgtaatacatgcacgatgccactgagttcctgcttcgtcaacttcatcgcttccctcaagacctggaaatggctgatcaatggcctcatctctgagggtcaatggacgaccgagaatagttgttagtgtccgatccattgaatatgccgaccagaatatggcgctacgtctttgtgcggtcacagggtatgtcgtcaaattcaactctggagcatctagacgacagtcttagagattattgcccttccatctttttgcgtccactcacatccatgccgtcgttgaaggccaaggtctagacagcttgcaatgatagtgtggagaagataccaagcatttaggccctttggactatagaagctgtgaagaaccatcagtaacaggacttgtacaccctccacgctatcctgaaggcatatctgggagcagtgagtcatggcagagacaaaaaagtcgtgggagtcaaattcggacccgagtcgtaattcaaggaaccgtgcccccaaggacagaacgagacctagctgcgccgcagctagtctaatagggaccggatgattccatgtagatgtctctttaaacttccggacttggcttaggagctcatatagcctgtcctgtgagatgaaaggataaagacacgtgctctcgaagtaagcctctgcgtactgctggcactctgttggggagggcaagtggatgggtggaatgctagagacttctgacgtgagcgcctgccccgttactgtaggtggaagagcgtgcagctcttgccgtgtcccttggcttctaagcagcggcaatggcaagccttgtgactggggggcgctttcatagatgagctgggcgaatgaaactccagatgatgggcctaaatatttaggatctgtattgctggccagggacagaaggccgacctcatgggccggcggttggttgtgagtgatctgggtcgagctcgggacagccgatgactgtacgggagggctgtggtggttttgactcaggtcaaggccatgatgttcagccactacagaggtttgtggtggacttgcattgtgcccaccaagcagttgattttgatcaaaggcgctttggctattgtcgaaattgtcgcgtagtggcgatatttctagtctttctagctctcgaacgcgccgttccagatagtacaatcggctattgaatgtattttatcttagcaggtaccttcgcaatggggaaggcaattaccttctggatacagcagatgcagctcgcccttccatacagtctacaccagctttcgcacagttggagcatgtgggtacggcgccatcacagcggacctttcgccgacgacagcggacacaagccgcaggacgccgtttatgccgagtcgaagtcgttgagctgtgcgtcttcgagagagcgtttgcagaagggcggacctctgtggttggataccatggcgggctcggctgctccatcctagtatatccggatatagcgcaatattgagatctttaggccgaaagagagacgggcagaaaccgggtatctcgtcatcagataaggcaacaagtttggctgagaaacagtgcgggggaagacaaactagtagtcccctcggctggcaaccgaaccgaggtgcgcttcaaaatatacatactagtttcggcgttggtccgttcgtcatactagtaggaggtaaagccgatacacaattccgtcagctcggatagatccgatagtagatcctctatcaatttcatttcccaaacaaaacgtgctctgccggaccatcaccacggataactgcggggtgcgggagggggtatgccatcgatatgcctgtacccatcatctgaaatccggggaaatgatcccaaggcaccttataagccgcaacgtggtgggactgccagtgggtgacggtgtctgcagtctcttccagtatgcatttccaaactactggctttaccattctgcaggcagtgcgttcgttgcatccagtaatagtcttcactaacattaagagttgtcccttcttgtcagtatgacaatcgtcaaggcccaatccgggctaacagtcccgaaatatgcttggtagcaccccccttgggtacgtggcctaccaaatatttggtttaactccaacacagggactctcatattcatattatcgaatccgacaagtatccactcaatccagatagaggtgcgcgccgttacccgcattctaaactaccgcccagttttgactaacttatatatattggtagagtacaccccaaaggcggcgactcgcgaacaggccgcagcatttgaacgttccatcggcatccagcatgctgtcatcgtcttacctagcgtatatggaaccaacaacagcgtcctcgttgacgcccttcgctcctccaatggcacttatcgcggcgtctgcgtcttggacctctcggcggaaattgataacaccacccttcaaaccttccacgacgctggcgtccgcggtatccgcatcaactacggcaacgaagggacagacgctcagatcaccgccgataccatccgtgcggcgtccatcgcgcgaattcacaattggaccctggagctctgggtccctatcgccgcgttcaagtccctccaccctatcattccaaccctgggtgtacgcgtcgtagcagatcattacgcccatgctatgacaggctcccgcacgggcaatcccatcaactctatcgaccccttcagcatcctcgggtttcgcgaagtggtggatctcatgcaacgacaccaccttttcgtcaagatctcggcgccgtaccagaactcgcggaacgagccgctgtatagtgatctgcgagtcgttgcggagactcttatgttacatgggccggacatggtggtttttggaagcgactggccgcatacggcgagtaaggaggggaatgaagctggcgggagattggttgagtaggactttcgggacgtcgatgatcgtgctattctgcaacagacgcttgagtgggcgggaacacaggcgcaggtgaggcggttgtttgtggataatccgagaagattatgggcgtggaccgatacggagtcgtgatataagtcggcgtaacaggaaattgttggtcacaatatggtgcctgccactcgccgaggccagtttatttcattaagcgattcaggtaatggagccccagtccagctctcgatggcttgcttgagctccctggcaaaggcagtaggagcatgtttgtcgaggaatcttctccgacaagcacaatttaagtcaagctcagactctaccatactgcttctaaggggccaatattcgtcggcgcagtaatgcatcatgtcccatgaacacacaaatataacacttaatgtgacaaacgaccagtgatacacaccacgcgaagaggacaacctaggaaaacaaaacggagctagttcgtctaaaacggacttttgtagtttctaaacacattcaatggctgcgctcccatcaggatattctgcagcaaggtgctgtaatcccaccccatcgctgacgcagcaatggccgtgagactcgcctggtcttggcgccccggtcgacctgggccagtcatgttctacactcactcagcctctcatcatcgcgactgctcaggattgatgtcttaccggcttcatatttatgtcaaacaaggcaaagtccgatccctccgcgaaccggcggacgtcgacgcgaattggcgccgtagcaccgatgagagcagcgacactctcgcattcacgcattacctttccgtaagccggatctttgagctcgtttggtgagatggctcgggaattggcagtcacggcgacgacaccattgtaaggggcgatgccttcggcgtggttgaagcgtgtgacggggagcatgctccagtgctggggacgatccctggttggaggcataacggttatggttgcctcctcaccggcgagaaacccctcgagcatgaccagtggcgattcatgaaggagggtttggatgtgttgctgtagttgggtcttatcgtgacacactttcactccatggctaccgcgtcctcgaatgggcttcccaacaattggatacgaattgatcttattgataacttcactgaaatctttgggactgacaagccacgagcttggcagagtatatctccccagctcccgtagcttatcgttcagataggccttgtcatcaaagtcttcgacaagacttggcggctggccgacgacatagatctcagaggccaaaggcgtgagctttgaagatgtttgaagcgggtgagaattcacaagtatggtgttagcccagagatgcgtagcgccctgatgaatcgcgctgcagatgccttcctccgtgtccgggaacgcccagcctttatgagaggagactgacaccgcgggatctgactttatgattttcacacccttctgctgaagggtgaaagcaatgtccgcgccggaatcttgatagcctgggggcaattcagctgtaagtatgtctctgagggcgaggagtgcttaccacccggcttgcgaggctttgtgacgccattgatcactggtgggtcaatggcctggtggagaatggccacggtcggggtctttgtgccgaaagcacgtgcggcctgcgcagatattctgactgctcttgaagcaaacatggtaatagcttgttaggagggtggaaaattgaaagggatgagttgacgatgacggtatttgaggttctgatgggctggctggaattctccggttggattggtctttcggtttttttccgttccctgggctactccgcactgtacattgtctaaagaccccaagtgtattcggagagtctccgaagtccatttcaagtttaataaggcgactaagtgggctattaagagacactatatgttgtcaaatcagcgaaaagtgcttccttgcactttgatgatcaacgccgtaggggctcagtgctgaacggcagtcttctagtctacagaagccagcacaacgctcgaaataagcactaacaaacccacttgcggtcttgtgtggagacattattcaactgttgatgtctaggaagttaacagccaagagaggaaagctgtatctttgtcgtcttgacttccttggatggcaatttaaatgtcaccagaggggcttagtcgccactgaaggtatgcagttattatattctctttcacacgcatataatcaatatattggtaatgtgatggagtgattctcgtatatgggcctcaacgtcttgagcaaagcgcgggtgccaatctgaatttgtatgatcaaccctgcctcccgttcaatttacacgctggccctggtccagaccagaatgtttcgccatggtcacgataccattctagtgtcattataagtccctcatcgaaggacactttctccgtccatcctaattgtcgaagcttggaatcattggtccagtacatccggtcgttgaagggtctatctgcgactgtctccagatattgttcgcaggtatcgctctggactgcatgaaaccactgaataattcgtttcgcaacgtctacgacctttatctgctctttcgaggatatattgtatgtctcagacacaaggcctcgatgaagaatgatatcgaaagcgctcatggcatcactgacgtagacaaaaccacgaactgcctctccctgaccatgtaaagtcattcgttgggaacgtagcatttgcatcgcgaactttggaatgagttctagcacaaggtatgtcagggaacagcagcccgttaaatcagcatcagggagctctcactttcagggtactgacagggaccgaaaacattattgcagcgggttattatgatgggcatgtgaaaggaataacggtaggaattggcgatcatctcagcagcggctttgctagcagaatacggattggtggggttcagctgatcttcctcggtaaaggcatagtcctggcctggcatgtttcctccgtatacctcgtcagtagagatgtggataaaccttattactgtcccagcttggcgtgctgcttccagaaggacatgggtccctgtgacgttgctccgagtgaaagagagcgggttaactagagattgatccacatgagaattggccgcgaagtggacaactgcatccactttgaactgctggaagagagcagtcactctgtcgcggtcgcacagatcccccggaaagaagtggaagttaggcaaatgttcaacgggttgaaagttgcgcttagatgcgcagtaatcgaggatatcaaaacagagtaccgtatatttcgttccgtatacctgaaggaggtgtcgaacgaaccagcctccactgaccaagcagtgttagtttacctatctgtgtctttgaaactccaataaccatagccacagtaatagactcacataaaaccggcgcctccagtaaccaatatggtcttcacgtttttcatggtattctcctcgtctgagccattgatttcaagtcgtggttgttggacagtcatcgtgcggccgacttttgtgtaatgatcgcacatagacagcacagttcttgcacaaagatttcgatgctctataagttaaacattagcatcaatggaggcacgtataacgtcatgggagcaatcatccctgttagttcagggagcctcgcattatttctgcctgttttgtttcaaatctgcggagccgttcacgcttcccgccatgctgacttctcactgccttcagtgttcaagcacccgtggttatgtatatgctcttgtttcggaaaacaggaatagctcaacaagtcccgaattgtagtcgattcgaagtagcagaagagcatatagctaggccattggagtatgccacgaaggccggcggattccccactatgaggcaacaggacacagcatacaattacacacaccaggcgatgggatcgggtgctccacagcactttgggcacccacaagaagtaatttggttttcgtccatgatgtagacctcgtgtctcatgtctatatccatgacggctgggctcggatttgcagttttcattgtcacttcgtggccaaggaataatgatggtgagaattccaacatgcacctttacgcagtcagcgtaaccaatacaccataatgacacagctgtgtgcgatcatctaagcacacggaggagtctcctagtcagccggataatcagaccatctttttcgctccaatgcgtacaggagtgcaatagttcgccccaagtttctgctactatctccggaccctgaagaaggcgccatagctaatatattgtacgaagatagtagagcttgtcaaaacgctcgtagttcagtaataggatcaggttccacgtctagttacctttcatttggaacacaaaccgactcagtcaccttggagactggactgagaatctccttaagtgaaaggcgtaagacgatcagcaataataacttactagtgagccccatcccagcggccgaatagtcaagtccagtctcttgatgcagtctccaagccgcaggtgagtatagtgggatgtcacggtctttggtatttagtcatcaagctcggtatcggcgtcaacatgcataaaccgtacatttcaataatggtattaaggactagccgaccttgaaagacaagttgttgctccgccgatgagtaccttttgtccgcttcgctcagttcccgagaatggccatcgatcacttctctcaaattaatggtcatcggtactataacaacaataactagtcatacaacaggtttcttgaaccgaactcgacagtagacacttgtgtggtacgacgacccatttgcacaggttcgatggagggtaacgccagggtatgttgtggtctatggttgaaagcggcggttacggccacgtgggggcgacccaaggcttagagaggcaccatgcgttagggacatgacatcagggactgaggatgcgtgtagacattgcggcctttcttggagctgcaggcatgggaagccccaattgcatgaatgactgtgggctaacaaaggacatggggaacgccggcagcaaggaattgagataaaagcgcaattcccctctcgtcatccttgctggtctagccagcaactgggatcagtcatgactgaagtccaactcatagccaccctgcgaccggcccccggaaaagagacagaagtatacgccccttacctcactgtttgtcaggcattgctcataacccactgacgtccatggtctcgttagctcagatgcctcctttgcgacacaacacatcttgtggagcaggcggagccatcatgcctgacatttcttctaacagaacatcaccgagcggatggcagcttggagttcaaggtcatcgaaaggtatgtgttgggcggacccggcttaggaatcggtaggaggattagttgacatggttacacagatgggccaatacgaatgcacttgagcaccaccataatcgtccctggctccgcgagatgtattccacattcctggagaagcaaatattagacggaccagagcagattgaaatgctgactgtcattgctgggtttgccgtgcgttagagaaatttcgcctatttgaggccctcgaggtactatattacattcgtgcacgcttcgattattaccccaaatcaatgatatatcatgactgcgatcatcctcgttaaagtggagttacattccagaacggaaaggaaattttggatttagacatggctaatcccttagctgtcgtagagaatgattactagtaccacagccgatgatttggtaacctttgctattgaaatatgtaacgcaagcggaggaaatgagccatagccgccgggactgcatgcctcaatagcttcaacatgcgtaatgcgttaccgtatcgagaggtagaatctggctttggtgtaacacacgttaattgtggttaatattctgaggggtctgtccaacatccatgctttttcctgtcctccagtcaaagctacgaaacagtcctgtaacctgcgaactggcgacacaagaaatgtcagactttacgaacgctatcaatgtctataatgctggttatcttgcgagtcaagtagaggatatacggttgttggactgcaacgcattggatgactttggcagaatcttacatcttgaagacggggctccataaggctacacaacccgtcttgctggaagatccaggcttggggacttagccgtgattgaaaggttagtgatcagagtggcttaaatactatctatcagaacggaagtccactgtatcctgctcctcaatgcagcctaggcgatcttgttgcactgccttgcattgccgttctgtccgccacaacatgttggtgaagcagttccggtcatcaaccacttttgcagttttggtggtctgtgtggcagtcttcactgatatctttctctatggactagtcgtacccatgcttccctttgccctcgccgagcgtgtaggcctcactgatgccgatatttagcattggaattccatcttacttgctagctacggggcgtccatcatgctggggtcatgtgagctattcattattagccgggctgacccttaccacagacacctacttactcaattatggttacagtgctttttggatggatgggcgaccgaacccgcacgaagcagctaccatttttgctcggggtcggggttatggggggtgcgaccctgctcttctcacttaccagatcattggccgtgatccttctcgctcgaatcctgcagggctgttcgaccgccatagtatttacaattggatttagtctaatgctggacacagttggggagcaacacattggacgtgccatcggctttacgagcatgagcctcagcgttggtttattcgcaggacccatcgtgggtggttttttgtacgacctggctggatacttcgctgtctttgtcccagcctttgtgcttgtcgtactggagtttgtccttcgggtgcttctcatcaggccgtcgctgaaaactgataacaagcgaaacctcaccgaggaggagagacgtccattgatgacggatgccgcgggaactcccaccacagtgtcgccaaggaagcctgcacttttatacttgctatgcatgcctaggttcattaccgcgatgacgggaatgttcatgctgaactcgttcatgactgccttggaggctgtgctacctgtgtatctccctcaagttttcccttaccggtcgacggagatcgccattgtatttccgtccaatacactgcccatgatttgctctccaatcggcggagctgtggtagatcgcatgggtccgttctggccggcggtcctcggatttaccttgattacccctagcatgatgttactgtcgctggtccgtgagccggaaatgatcatgtctgtgctgcttcgactgttcttgttcctgttcggctgtggggtatctcttgccatgcctgccatgatgacagaaattacactagccaaagacgacatggaggttggacatccaggaatctatggagatggaggcgcctcttcacaggcttacggtctgagtaatgctgcctttgctgcagggacactggttgggcctttgtatgctggatatattcgagagagtgtgagttggagtgcaatggttatttccttgggagccttcagtgccttgatggtaatcctcgttgttgcatttactccgctgaaaggtcgcgtgttacacgggagccgggtgcctgattcaacaaggcaatgatgcgatcatgtaaattacctaaaaagatcgttccgcaatatgccgaactaaagaacaaatatgtgctcagtccatctttgcgggcatacacagtggatactcatccgcctcgacgatatctgaaaagtgaagcccatgagccttgcgtactgcatccagtatatcgagaacagccaaactctccacccacggcatggacgcactttcctggcgcccatctcggacacatcgggcgacctcgtccgcctcaaagcaaagcccatgcccgcctcctggaatgcgatactcgaactcttccgcttctcccaccacaccaaaccgctgctctcgtttgacgacccagtacttggatggacaccaggggcgcccataaatctgaatctcccctctgtctccctgaatccgtacgactggagtgtgaccatccggatctgcagtggcgcggaggctggcgctggcaatcgcctgcaccgagacaggcgacggacttttggcagagaaggtcagaaggacggttgtcgattcgtccaccccggctgagacaaggggcatggttgtcgagaaaactgtgctgggctttgggtcaggcatgggtgaaagggcctggaagatccaatggatcggatatacgcccactacgctccagcaaccattagtttcgtttgacgcacagaaaccaaacagaacgtacaatcgagcaacgcccctccagccaactctttcttggtcagataactgtccttcagctcctttaaagcgtctgttccgatcgagttgtccgcgaagacccgaataacgggcccaatcgcacccttctggatctcccggcggatctgagctgagattggcaggaaccgtgtccacatgccttccatgaggaaacgttcacgctcacgagctgtctcgacaagtcgatgtgcctgtctagccgtcacagtgaatggtttctcacagagcacgtgctttccggcctgcagcccgagcatggcgttctggtaatggtgggaatgtggagaggctacatagacgacatctacgcgggggtccgccaccagagcgtcgtagctaccatacgcaatgcaggacgacggcgccccgatcttgttgatgaagcggctggcgatctcggtggatcgcgaagatgccaccgccaccaataaatgcgacacatcggtaacacctcgcgaggcgggatcgatgagaaggtcttttgcaaatgctatatggcagattagacactgaaataaccagcactacgggtcaagtgtattactctcagcaatggtgccagtggctaccaaaagtcaatagtctggtcaacgtgttctcgggtgggccaaggtaagcaaggcacataccgaggataccccaacggaggcagaatggcacgggcgcagaatgggcactcatgctcgttgagaaggtagatggccggcctctttccactaagaaagccagggataagcatgaatcgacggcttatcgcagaagaagaatagaataagtcccatcaagcaccttacagtgagccaggtcgtctcaggtttgagagcctttacctgtgccatttctgcccgcccccaaccacgccgagacaattgggcaaacactctattgtgtgacaagcgtgagacaaactgacacacaaccatttcacaataatcataagggaggggtttgtgttacatgccacagcagcacgagggttggtaacatcaggccgagatgaccagggattcgaaacttctgacagtgcccttcacggcccaatacttcaagtgatccaagaactttcttcttcggcgaccgagctttgagtgtggttgggttcgtgcacgtcactcaagctacctagcagggaaaatagataaaatgtgacaaggatagcgtgactgatcacatatgttgtgaaaatgacgcagctggctaatgatggtactgtattttcatgcaaaataagtgcgtcggtcagatcaagcagtatttaccatcttcagcaagacttccgttcctgaatccttggatatggccatgtcggaggcgagtatacctactttccagccaaccgtcacgggccaggagctcgaggccatccaagaggtactcgccagccgaactcttacgggaaaaggcaagtacacggcactgtgccagcgatggattgaatcaagcatgccacatggcaaggcctttgtcttgagctcgtgcacttcagccttggagattgcggccctccttgccgatctgcgaccaggggacgaagtgattgtaccgagctacacgtatgtgtcaaccgtgaatgcctttgttgtccatggggcgctaccggtttttgttgatgtggaagagacgaccctgaacatcgatgcgcagaaagtcgaggatgccatcacgccccggaccaaggtcattgtcccggtgcactatgcagggatcgcctgcgacatggacaccatcctggacattgccagtcggcatgacctgctcgtggttgaggatgccgctatggcctgcggcagcacgtatcgaggacgcgcgcttggaaccatagggcaccttggctgcatcagtttccaagagaagaaagtattcactagtgaaggtcagggaggggcattactcgtcaaccgggactcactcgtcgcgcgggctgaaatcctctatgaacacggcacgaaccgagctcagttcctgcgtggcgaagtggatatctatcgctggctggatgtcgggattaacgcaaccctgagcgagattcaagcagccttcctatatgcccagttgcaagccgcgccgcagattctttcatgccgccgacgtctctggtctcgctatcacagatgcctggcccctttggccgacgcgggtgtcatctgtttaccccaaccggctgcggaggcggaccataacgcagccgtcttctggcttcggttgactgacgccacaaaccgatctgcattcattgagcatatggcggccggacaaattcagacacaggcacagttcgtgccgctacactcttctccattcggcgaacggttcgggcgttttcatggcgaggatcgggtgactacacgcgccgcagcggagattgtcttgctaccactttacgcggggctcacagaatgtcaacaggaaattgtcattcggcgcgtgttagggttctggcaggaagccacaagcaccccgagaacggaagcttcccgcgatgctgaagtgaataattcttaggcaatgatttgcatctggaaatctacctatcagtgctttcctcatcccttcggagcagaaggggcgcgctgcgagcagcaatggtgagcctagtttagtcaagccgtcacaatgaatatattttgcggatacgaagaggatagaacacctgagacggtgctaggataggataggaattgcaatcgtaatatgtggttgagtaaatcatgctgtacatttgacactagtcttgacgatgcctgtcgggctgtttatacacggagtatcccctaatccaatatggcatggggcaagctcaggagcgcccttccaccgtacggtcatctttgctcgtgttgcgcgtaacagtaaagcctaagaccctacaaagcgccttcagtccatggccgagaatgtacagccccagactgatgaagttaagccacactagggcgatgaagtagacgattgcctgaggtgggatccatcgaaataactgcgtcggatcgaagccagccttttccttgaactcatcaatttcagccagcgccgttgtcgtttgggtctggtcggctagcggctctgcctgccagttttccgagaagttagggtcgttgtagattacggtcgccatgacgccgccaaagaaggtcaacagaagcaggaggacgcctttggtcagcagctcgtacagccatgtgctgcagaaggagacgagaatgagcgagccatgtcgggaaccgtagtctgctgttgcaaggagatgcgcgatggttctcccctcggtgggagcgacaggctgaaggcggaccagcaatcggcacacgaggaaggtgagcaagctgacggaggcagcttgcgcggtgaaagtggcttcagtattgagaacattgatagcggtcaaactcaaagcggtaatgacccacgaggctagaaagccaacagcgagaaaggtggagatctgcccattgaggcgggagagggcagccatggcaggtcaaacagcgaaactcgcgggtggtatggtggtgttgaacgtttctcaagctctgcaaccggaaattccgagttttatattctacaggtgatgctgggcgagccgatttaaaatctttggacccttgggtcctggatgagccgaacagcgatagtgttgacagggtcatcacctattcccgaaagagtcgaggacgaggctattccaggcctaatatggaaggcggacgctgctcggctgagacacgccccactgttcgtctttcatcttctgtcagggtggaaaccctttcatctccaggtatctggctaggtagatatctagtggtaggcagacacggttgcctgttaggatctctaatgaggtagcacggtttcagcctctcgcagtgagtcaacagtgagcagccaaaagttttcacactaagtttgcgatagtggagcgtccgaggacgtcactgagagtgaatactatataagagaaataggaggttacttttcctcttcctcacaaagaggttatgcaggatccgttgggttccgagtgatcctcaacagtagtcattttctgttgcgccgggaagaatctcctctctaacagatggaagaaaggaactgcatcaacatgagtctagtcacgatgtcttcatgtgcctatgtagaaatttccagagatgcattatatagtacaatgagaacgtgtctcgcgttctcttggggttccctcatccctttgcaaactcttcgcggaagtctcggatagactccttgccaagacatttccatggccccgaacaaaaggctgaaattactgatcaaagggtgcgattactaccagcatagatgctgactaggattctcagagggtaaaaacccagcaaacaccgagaattgctgttatctccctctacttgggttttctctcgcgataagtctttcctcaccggcaatccacccctcagcattgattctatccgtaatctgccgagtatcggggaatcctcggaagacacaatggatcgaatgggattggattgtgtccggagactaaggagcaagaatcaaggaacggcgcaatcgtgccggccggttcccttgtggctgattccacgcacgttccatccaccacgaaccatattgcacaattctatcaaatctccatcgcgcagctaaaatagtactgtactggatgtccactggacacaataatggccctgacacccgaccaccggctgaagcaaaaatctttgcatcttttttagtccttctcacgccagctccccgatcgatcgatgaggaggggttatcgccattcagggcccaataactcacgatgatcggtgacgatgaccacagaggaccgtcattgagcggggatgtatagtgggttataccgcggaccagggccaaccagcgaagcatttgggggatcaggccaggaaccaaaccctgttgcgtgtcgattcctttgcctctcaagctttccgacaagccccatgaggatccacccatgacgccagtctttcccatgtcttcaacgctccccgatagtctgcccgcaccaccgcaacccactggcctgtactttttgtagatctcgcgcatcaatgctcaatggccggtgtggatgcgctcgcttacgccctcgctgcagtctctggtccagtcggagatgcggagagggcgccagcaagtcgtcatcatgtttgctgctccttcacgccattctttcttctcctgtctttaattgttcccctactcctgttgctcactggccaatttttcaacgtctggaacatcagctgggcgtcttgagtgtgtcacgcagccattgcttccagttgagtcggccatccgcatcccgtccattattcgcatcccatcgacaggagcaattttatcacccttcgaataagcacatagcatctatctccgtcacaatatggacgacggggagaccaggcgcccacgggcaacggtatgttcactcgtattctccttcagctgagccaggagctgatcggagtaatctcctcgcttgagcagtctgatgcgatctccccccgaggagagaaccctcccacttcacctctatcacctactcgcggccgccgagggactgctggtgacgctgactttgtttctcccacccgccgcgtctctggccgtgatggctccggggctggagttcgtcgacgcagctccgccgcctcccgtcgcagtggtggaagtggcatccccagtttggcgccacgcaccacgctggctgaacgaacccaaggtcgtttcaccatggctggcccagaagagacgcctcagctgcgcttggcccatgaaccgtttgtgcaaccgggctatggcgatctaaacccatcctacgaacagcccgccaactccaaacctgtctggggtctggcgaaaccgctccctcgtgtcgtccgaccgggcatggtgccgaccaaggaggagctgttggaagcccgtcaaaatattcagctgccggcagaaaattcacagaagctagggctggaggtcgaccccaatgacctagagctgggccaaatcgagaagacggctgaccctcgtaaaatggcggcccaggtggaagatgcccgcatccagcgtgagaacaacttcatgaacaagattctgagtggggatgccaccacaacgcgacaaggctcgcgcctctcgcggacttcatcgtcgcgtatccgccgcccatcggcctgggatctcccgcctgagaatctctcgacggtgcccgaaggcgagaccccggctcccagtgagacccatgaggaaccccctcagatgagtagtgaggagcccttggagcccgtcctggaggagcccgagctgcgcgctgacgatggcaaggacgggatgatggacgacctgcccaatctggaggagatcgaggccgcctatccggaagatctgcatccgctggtacaggagctggtggaggaggaggtgcacaacaaccacaccacctggtccgtcatccgcactcatcaccgcgaagccctggccgagtccctgggggtcttcgtgcagctgttcgtcggcttttgcggcgatctagcagtgaccgtggccaacgccggtaatcccaacaccaccgactgggtctgggggtttgctaccatgatggccatctacgtctccggtggtgtgtccggtgcacatctcaatccgaccatcaccattatgctatggttttaccgcggtttccccaagagcaagatgcccgagtacttcgccgcgcaattcttgggggccttcatcgccgcgctcgccgcgtacggtctctactatcactccatccaacactatctcctgaccaactccaccacgggcatcatcaccagctttgtgacaagtcagcgcgagacctggatcggtcctggtactgccttctttaccgaattcctgggcacgatgatactgactgtggtggtcctggcgctgggtgacgatcaaaacgcacccccgggagcgggtatgaactcactcatcgtgggtctcatggtgacctgcaacacgatgagctttgcctaccagacgggtgccgccttgaatccgagtcgggactttgggccccgactggcgttgctggctctcgggtacggctcgtcgctgttcaccaatccgtactggttttacggaccatgggccggatcactcgcgggctccttcctcggtgccttcctgtacgactttatgatcttcacgggtggtgagtcgccggtcaattacccctgggaacggacgcagcgggcgatgcgcaagagtcggatgaagtgggggaagcggttgcatctgtcgcaccgagacaggggagagaagactgtgcgttgaacaggagcggcgtagacaaaggggaattcgaatttagtgcagaatgtttcaccagattgtttgagaatgccttgctacgtgcatgcgggatgcatactagtgatgtttgtagttacatgatacactcatattgaccgcaatgagcgatgaacgttgtacatacccattgatgattcgggttctggataatatatatatatatatagttcaattactttcttattatttttataatcatagtagcatcccaactcatggcgaggtagtgctactacttaatagccccgcgattggtaacttctctcgcctttattgtgccagtacttgtatattcccctgcggcaagccgatcggtatcccgaggcaagtatcgggccacccggaaatcgaccgagacgcgggaaggttgacacagtcttcttgaccgggtattgttatctgcaccagttgttcttgttctttcatcatctgcgccgacgtgcctggttgagagcgtctccactgcgactgaaaatgacgtcaccaaccatcgcccccaaaaccatcacactggatatgatgctcggtgatgcccagaaaaggcaatagacagcagagacaaggatacggaatcttcttctgagacgccgtataggaaaccgggacttatttagtcgaaggaacccctgcaacctggctgtgattgtagtccgacccctccgccctcttgtcaaccgtcaccaccgccatcgacatgagccaggatgcagagggaggctatacaatgtctccaatacgcagggttacctcatcggtagcctggggctggtatgctatctcactcagctggggtgggatagcggtgctgctgcaccagacccctaaccagttcaccggcctcacgaccatcggaaccatcgtctttatcgccaacctagtcatctataccacagttaccctctgtcttctcttcgaggctgtccgaccacagaaggttcccaagcccttggaggagtcgcctaactttgccgcgcggtggctgcatatcaagaagccccaggacctgtactttgtccctgtttcgctgctcgcattcgcgaccatcatcttctgcacctcctactacggcactccgcattgtggccgttggttgatcctcaccctgaacgtcttcttctgggtctacaccggagtgtcgctgctgctgtcgattctcttgggctggtggatcccgtatacagggaccaatcatggcgaccacttcgccattgtgaacatcctaccctactttccacccatgctcagtggcaccatggccggcgtcttggccccaaaccaggaccctgctcaggccgtccccatgctggtaggtggcaccaccatgcaaggattcggattcctcatgttcctggtcattttggtacagagcctgacggagatctccagcgagggtctcccagtgccaaatttccgaccggagatgttcatcgcagtgggtccgcccagctttacaattatcgccatgatcagcatggcggatgcggcggttgagaaactcccagaccactatatcagcgctgcaaccagtgtgcgcactgcggatgtcctgctgattgttgctgtggtcgcgtcggtcttcttatggctcttggccttctttctgttctgcatggcggcactgagcatgttggaggctctgtggcaccgcaccattcgcttcgagcttatctggtggtgcatggtcttccccatcacaggttttgtgctcgccaccatcgacatgggcgagtatttggcttcaccggcaatcgagtgggttgggagcgggatgaccatctttcaagtgtgtttgtggttgactatcactgcctgccagctatttaaatgggtgtataagagggagttttagcttcatcatgcggcatataccccggacggagtggttattgctcactagagaggagagagaaataaagcggcatagctggctatttcctagtcatttgcggttgctatatcctttagagaattttaataacaacgtcatgttctatatcatatacgccggaaatatgccatgccatcaattcggcagttcggaaggtaaagtggtggggttgactgggaggattgcaacttcctcacttctttgccggccatcaatacttcctgttgccacggcccttcgctgtccattctcgtcttcggtccacttgagtggcccttgcgggagtgcctccttactggagctggtccattgtagagcctgctgaatcccctcatccaggtccggcagcatcccattggtgaactggaaacctcctccgaactggcttggaatgtccttgtggtccatgtgttccgccatggtcgcgtatgcatccgcgggcctggtgatcaccagcttgtcagccgttatggggtcgacaaagttcttcataaaagcccatatcttggcgaagtagaagggcgcattgcccaactaagagatgagttaacatcaataccaagtcacggtgtaagcacccttacaatgattcgatcaatagtctccggatagcaggtcgagaggatccagctgatatcgcgtgcaaattcccgcaaatcccaggcttgcttcagagatagggcggaggcatcgacgatgtacatggatttgtcgatgggggnggtcgggtcgggacggtcgctcatggccgagcaaagcgggagcacgaatcgagtaatgctgtcaaaatagattgctgcgcgttgttccatatccggaattatagtacccgatgcagttaattcagtgttccttgaaatgtcgcgcgtctttctccaggctgccatagtggatgcgttcaaatgagcaagatcgagcaccaggataggtcgccctcggcggtcccgtcggcccgtccagtgaggatactggtcatcgtgtgaattactactactttggttgccactcgcgagatttcccaacataccagctttcgcgtctcctcataatgctctacggagatcagatcatacagacgaagaacctgtctgtcggcctgaaactgggttgcctcttgcaattgcttcagagccgcttttggatccatgcgacgagcccccaaatatcgtctatatgcgccaatcagtacagcaccgatgaatagagggttttttgctcacaaaagagtagtgttgtcgttgatcccatcaacaacatctccagcttgtaacccctcccgacgccccaacaggccttctgcagcacagcaactcctgaaggtctctaggacggtcgactggtccggagctaactctcccatcttgtgatgtgaaaaggccgggctccacagatgaggacgatggaatgcgaggagggtaggaaactgatcagatctatgttgttgcaggataatggtgctgattcagtctcttgtggttgcagtgtgacggcggggttcctgtgctgagtggctgggggcgcggctgaaagcgtcacagcctgctgcaggatgtgggatggctagcacattcccaacattgcgatgcaatgtcattcgccttacgcattgtcaaacccagcttccggtacctttctccgccatcttacccctctgaatgccgtcgttcggggctttgccagggttgttagcgtagtgagagatgaagtttaaatccatgatatgatgatggcttcacctgccgatcttccggtgcccagctctcctcacgaacagccgcaacattattggcccgggcattgcaaaggacccgaacttagatgaaatgccgacatcgaatgtctgaaatcaatgacttaagctttgaacctgttcctcgaatgagccgagcttggatcatccttgcaagctttggtacgtactctgtaatcccatgaggtgatctgcaccatcaacgatcttcaagctcgccccaacccaattagattcgaatgaggaaggctccaagtggattgaagtggattctttcaaccctggcacacctcatcgcgacgcaacttcggtggatgattcacagacccccactgcccgcaaggggttgattggcctatgtctacaaagatcctctcgatggtactatctctccatcaccttcagatcagattgtccttcccgctcagatgaacgcctgttcgcgtgaacagaatctccttgctggcaatggatgatgttgacaattacactatcatgcctcattatggagctgccagtgctctttccggacaaggggctcgtccgtccataatgatggatttaaagacgaccatgtcagttttggaaaaactgtcttctcttggctcctcatctttcctgcataatctgcaaagccattggaattgattagcggtcggatatttcttgtcttcagttcatgatggcatttacaggttcattttccgacgattactccgatcccgtccctcggacctgtccggacattcaaggattctgcgaaaattatgccctgcgacgtcacaaatttgaggattgggccaacgcaggatcccaacaatgccgagacgattgggagcagtatatcggcccgatagagcgctggggatgctgtaatccgtgggagggtcacttctccgcggtcgtcttgcccttttgccggcccgatcgtattgccatcatcagctactgtttcgaatgtgagatttcactaactcactggggcaaccctcttttgccaaggctcacatgagatagatgcattcatgtacgataacgtggttgaatcatccgccaaatccacagtatgcccgatagcgaagtttgtcttcagaaagttattcatgtctaactaatgccaggtgaacaacaacacagacgacattgccctcgatgagacggaataccgaaccgtgcggtcggtcactgggaccaaacagatccagtcaaaaatgttactcgacctcctgtcaatcgaccctgcatgtgctgaggttgtcattgactcctggaagacaatgatcaacacaaccgcaaagcaggacaagacgcgcgcatgcagtaacctggaagaatatgtcgactaccgtatcgttgacactggagcaccgtaagggattatcatgtcgtttctggcttttccatggatacctaacagacattatagatttgtggacacattgatgcgtttcggaatggacatcctcctcacgcccgaggaagaggagcttgtcgctcctattgtcaagccgtgctatgctgccctcggacttgccaacgactacttctcttctgatatcgagtgggaagagtttcaaagttcagaatcaagccagaccgccatgacaaatgccgtctggctattcatgcaatggcaccaggttggcaaagaggaagcgaaaaggctcgttcggcaagtcacaaatgactacgaaagagagtaccagcaacgagtacaggaatatattgccggcgaagggaagtccaatagtaagatccaattgtacctcactgcattgggataccagattcccggaaatgtcacctggagtctgcgatgtcctcggtaccacccctggttgtgtgaggagggcagtgccctcttgcaaacgtcgatggaggaggctcgcgacttgcctaacgtaggtaaaagacggagtgtctcagaagttagtctctcgtccgagtcctccgtctggtctggaacaagcgatcgttctgcacgctcatcagtgtcctcggcaccttctctcgacgatagggaaaaggagcgcgaccgtgttacgcttggaacggaggtaagcgcgttgtcgaatataacatgttatcaatcaaaggttcctgacagcctacgcagcatctccttgctccagcagagtatatcgcctcactcccctccaaaggagttcgcgaggctttcatcgacgcgctgaatgtgtggcttgctctcccggatcgtttcgtaagcgtcatgaaatccattgcaaagacattgcataatgcctctttgatgtgagtgctcgaatcaaattcgtgccgtgaattccactctactaacgaccctgccatcttgtgtaggctggatgacatcgaagatggttcccctctgcgtcggggccagcccgcgacacacaccgtcttcggacaggcgctcaccatcaactccgctaactttgtcctcattcaggcgatggaccaagtgaggttgttagaggactcgcgctgtctcgacatcttcgtggaagagacgcgtaatctgttcatcggtcagagctttgatctgtactggacacgacaggacgagtgtccttcagaggaagaatatctcgagatgatccgccaaagtagtactcacttttctccctctcagacttttctatcacagattttgtgctgactaaatagcagaaaccggtggtctcttccggctattggctcgattaatgatgcaaaaggcaacatcaaagaagaaccggtaagaagcgcgaacgctttgatggaaagagtttactaactttcccaacacaatagatgcctcccgttggaacctcttgtcgaccttatgggagaatactttcagatccgagatgattacaagaaccttgccgaagaggtcagtttacccacacagaacgactacacatgcaagctgacccaaaatcgcagtataccggacaaaagggcttttgcgaggatctagatgaggggaagttctcatttccgctgattcatgctcataagttcttgcctgagacctcggacattcgaaacatcctcaaacaaggccgccggtcggccggacttgggatcgcacagaagcagcgcgtattgggctggctccacgagagcggaagcatgacatacacagaaagaacacttcggagcctgatgagcgaaatccggcatcagatcgatgggatggaaaaaaaatcgggctgcccgaactgggtcctgaaactcctcgttcaccgactggaagtctgatattggttagatggattggtgaaattcaacgactgcaatgctttgtttggcgtttattccgcatgtggggaggtgactgttgctatgagatctttgggtggccttgtgaattcgaagatttgtggtatatagaattctactgtgtgttcttacatatgaagacatgagtacctaaatagatcggccgttgtgcaagctttacgtacaggtctaggcggggggtaggctgtgcgatacttggactgggacacttggcatcctgattagccatccagaacttcacattagcgtggaaagctcccatgtctgttccagcctgccttcctaatacttcgtaattgtgttgttagtttgacatttagtccgtctgatcaccagggtcctttggaaaggctgtctcgccttgccacgtttaggaaggctaaaacattgagtatagatggttcgatctttctaaatctagtgtcagcgcctaacaactggacgggcatgcaagtaggctcaattgacgtttcgcgggttacaggtgaggttcgggccgcccgcagaggcttgtgtgagacacagaccttttgagaccaaagtcacgccatgccatccggtcgaccgacttccagaggcagccagtaaaagacggaatatcacgcgtagtgcgcggggtagcacacaggatcggccacactaatgcaaacactgctccgagacgggccgctttctgcctaccagcccgcctaggatggcggcccacgaagcctgttctctaatgggcccctctatcgtaccaaacacgaagggcagagaaaccacgagttctagcatttctactgtatcgcgatatcctggcctttccgggaactacaggggcgggcgtactgctggtgccgcctgttactcatgctccaggggtggcagcatcagagttgctactaagcgcctaaaagcacaccaacagtataatgccgttattactggccaatcaaagtcccttgtatactatcagctttatataagatccttctgtggtcgggtaaacccgatggctctcatcctagcaatgtgacacgctgacctcaacccatgctttgatcgtatctttccctggcacatacagttggcgtcctcccatccaaacgtacacgttctttgcaaaccggtaggcgtaggtgaaagtaccatagcttcaaaacttactgaactccaatgtatcatcacaggaaatgaataaacatcacccccacttgggtcatatagatgggatcttaatatgcccttcagtgcgtcacaaagagacctagcatatatctccttatcattacctctgatacatagcactgctcccgtctccagagaaactaataatgatagctgtgctaattacgcgccctgattcctcaatcgttcaacgctatgcttaacactatacctaatcgatgtcacgctagagatttagttgaaactatgctgcaatgtgaccaccaccatttacgtgggcctcagcggttggacgtgtgattatccggaacactcaggcagtttgccgttacttgaggcgtaccaaagagcacatcttcatctgggcttggtgggctggctttcccggcagcacaccattttgccttcgtcttcaaagccaccagtcgtcggcgaactctttaccgtctccagtctatctaagtcggtcctatagttctattgacctgttttcgcccagcttactagtagatcattcagtaagtattgccaggggtgtacgtagtcgatcgattccatggtgtatcggtcacaatcagggcgcctatggatgcgtccaggattaaaataagtcgccgccctccaaggctgatatcatatttatacaaaagacttttctttgcttaccattgctgccctgatcgttcgtgaatttccaatgatgatatacacattcagctttgttctttttctatcttcatggataccctattcacaaggctcacttgttgctccttccatcgatacttccggtcaaaatgctacctcggtaaaggcggcgaacgagacagcttcatcagggctacatcgacaaggatggacaagtcagccatctggtcgagggacactcgatataatttgggcttgttgtttcactatgttcttatgttcatggtcaacattgtgtatcaatgttccggcgccaggagattccagcttcaaaatttttcggcgtaagctctacctgagcgcgttggctctacttggacccgagttcatctttcagattgcactttctcaatgggaatcagcctgtaaatcagtcaaggattttgaggcttcaggaatcaagggctggacaatgacacatgctttctacgctgatatggggggttatgtgctcaaaccgagggactggtgtcagttcccaatcaacgcaggccaactgcattacttggttacaaaaggatacatcagtcccccgagtctcgacgtgagtatcattagggaccgaaacaaggtggatggcatgctccggataatcactgtatggcaaacgttgtggtttataattactactgctgaacgcgcagcacaagacctggccataactacattcgagcttacgacggctggctttatcgtctgcagttttgcgaccacaatctgttggtaccacaaaccagcggatatccaagtgtccgaggtcatcgaaacggatgtaaccatagagcaaatcttgcttgaggcagaaggacatcccgggaggccgtttagtcgcacgccattggattttattacacggaaggaatgggcctggtcgctatactggtctaactggacgaatattcttcggaagatgcggatcgtgatctttctctccggacgtcctgtcaaccgcttccagaacactgttgtgccggaaccctcgaagctcggctacgctatgttccttctcctctctgcgatctactccgcaatctttatttgtgggtggaattacagcttccccaccccggcagaacaaaccttgtggagggtctcgacagtagcagtgttctgctgtgttcctcttttttgggcggtcgggtcatttgctttctcattctggccatccattgcatcgtcacacaagagctcaagtacgatggaatctggcgcgattatggtcccaacttctgctcattcatcattctggttgtcggttaagagtcgagcgagccgaattgcaaaccgcatccgcaataactcccgtgaacgagatcctgagctaactgtgcccctgaaagctatactgccgatctacgtactgggagtggtatactgccatgctagagcgtatatcttcctcgaggattttattgaacttcgatcgctaccagcgagcgcttacgctacagtggattggacaaacatcttccctcatttctaaacgcagtccacccgcgtttgggattcatgtttctcttctattcgattgttctattcttgctgtgcgaactgtgcgaaaactggtgttcttcaactcgattaccatataatctactaccccttccaatgcatactcctttcttgggacactggactttactatccgcagccacggactactgaggaatgataaagtatatcacatgtgcttttgtatatatactggtaaatacaccttcatagacatatcaaacacaagatcaaaggtggtcgtcgttcgtacgtacatgtagattcaaggggagcatatcggtaacagatccaggattatatagccttcttcacctcgccatctagcccttgtctatccccaggcttccttgcagtaacacatatataccgatgcatataaaggtaccggtagcccatgacagccgcgaccgcatttatgaagtacttctccaggccgaagaaggatatgagaaggaacgggatgtaggcgacgataaagaatagtcggagcattggctttacattttccgtgaggtccgtggactggatttcaatgaagccagcgtcttcgagtaacgactggagcgtcccttgctcgaaggaaatattggctggcatcgccgcgtacttattaatttgcgcaaactgcctccgcatgtcctcggttatattatctccagcgatattgatatggtcgtattcgtacagggcgatagatccaccgggtgcgaggacgcgacagaattcttgcaacgcagctttcggatcggtagcgtgtacaaaggtctccatcgtgtacaagccatcaaatgtacgatccgcgaaattctcgagatgatgatagtcgcctttttgaaggctgactgaattacttagtccagccgcgcggacattttcttttcctcgggtaacatgacggtcaatcacatcaattcctgttaccctcagaccatgcttccgcgccatatggatcgccacatgtgcatagccgcagccggcatcaagtactgtcgcaccgggcggcagattcaaggatcgggcgaggtgatcctccatctttcggagagctgcggttatggggaacggccaccagcagccgggttcataataaccgaagtgacgtgtaccgcctaggaatgctcggtagccaattcgggattcaagcgaattgtagtaggacaccaatggtgcattttccttgatgaggggctcggtttcggaggcgctcatttttgatgatcaacggccgattttatagctgggagaagcggacgaaggaaggatgtgagaatgacaacggtcgcagctccctttaacccccaaacccggaccacgccaggtatgcgggcgtgattaagtaccgcgaatcgcatcagcaatgaccaagcgctggcgctaaagattaggggagtcggtgttatcacactaagccccattgcaggtgcgtctgtgacaagggtgtgcctccctcccagacgaatgatgtctctggactatgcgctagtgcggggagaaacgctttgctagctggccgccaacccaatggaaggacgtcttaagcccactggcttgcgcagtcgaagtgtccaggccagtcattgggcccgacttgccctcgagagatgaggcacctccagtacgtactttaggacagagccggcaggtctcgctcgcgcggtggccgggttgttcaggcccgaagccagaattggcgtagatgattgattgattgaaatgccattttgcggtggttctaggcggcgggagagcgaaagagaccgaaatccaatgagaaggccaccccaacttaattcctctgctaatctggtcaaggcatctccgtaatcacccacaatcgaagctgcgggatgcgccacggtgtaaagagcagcggaagcgggctatgcggtatgatcgacggtgtcgacttccggatcatcagcgggcgcgcggcagctcgtcctgccggccattaactcccaagaaggggagctacactcacctgggcctaaaataaactgaggccctttggggaataatttccctccatttgtcatatcataatcggtcagccacagcatatatacttaggtgacaacccgtaggacgagattctgcaaaggttacacgactgcggtcgcgacccaaacgctggtagtgcttatttgggtatgccgtgtgaccatccgcgggaggcttattcagccgctgaaagagagagaaacggcacaatggcggaccaaccaacaatggggctcatttgcaagtaggtttgtaaacaaagccgaaccggggcctaagtccaaaaccagaatatgcaggaataaacaaagcaaatcggtatggacctaagaaagtcattggcaaagagaacaaaatatctttcacgtaaagggtgagcgactcaagatatggaccaccgatcacccgtcgcgtctctaacgagccaccttgcgcagcttactagcaggttggtgatgctcaaaaactgttgcctgcatccatataaatcatacataaactgggatcgaatttcctataattaaattcgcctaccacaaccgtggacgtctaatcgatgatcttcagcggatcagggacaaaaaatagccgttggagtgctcggatgtccttgcggtgaaagggacgggagcgagaagaagacagtacatagttagcagtcacggcacacatagtccaggacacagtcctacccacaaactgtattgccggatatcagagacctttccatcagggcccaacatcataacttcacctctatcgaccaggaaaggcgttgaagatgctcgagcagaccggctttcggtggggtttcctgactagcctatgacgacccgcccgactactgtaagtgacgacagtcaactggtgcctggcaggaagtcgactctgcacctgggtcttatcatgctgtaagcggcaccttggtcctcacaatgtaggagggcttgtttcgtctttcccttgaggtttgtgccagaagctctgctctcactcttgactgatttgatctgatctctagcaatggtttccaatgcaccatctcagtgctgcatggtgggacacctgcacgagggcagggccagaggggaggtccgacaaattgccgacagtgagcctttggtgccctacattcccaagcaccactgacttgatagtttcgacgtacatcgtctatccaaccgatcggtcgacaaagaatgccatcttgtttttcaccgacggcaatggccaccggttcatcaacgcccatttgatggcggatcagtttgccgcccgcggctacctcgtggtcatgcctgatctattccacggagaccccataccaatcgattatgggcctgacttcgatattatgggctggtacaaccaacatctgccacctagggtcgatcccattgtcgatgctatgctggggcagatgcgcagtaccctcggctgccagcgagttggcgctgtcggatattgttttggtggcaaatatgtgtgccgctacctcaaagcaggcaaacttaatgcagggttcatggcccatccaaccatggtgcaggtgggggagctggaaggggttgaagggccgttgagtattgcagctgctagtgagtggaggagaactatctcttccctctcccacatatcggttatactaacagttacataagttgttgatcccgtcttcaccactgccaaccgccacgagagtgaggcgatcctagccagacttggtgttccttttcaaattaatttgttctctgatgttgagcacgggtttgcggtccgctgcaacttggcagagccccagcagaagttcgccaaagaagcggcatttgagcaggctgtggcgtggttcgatcggtatgtgaaggaatgagattcacaagtcgtggagattagtgtcaaagaagacctcacagtggcgagaaactccatacgttatacaccaccaaaatccagggcactagtaagaccgtagacccagtctgctctgaatggtgcctataaatgtgtcatctcctgtataatccggcagcttcggggctccgatggcggcacggaatgatactttattagggattgcaacagatcctagacactcctccactgatgttctgaagatttaccctagctctttctggtgagaaacccaacttagacaacacataactccaactacttattctctgaatcccgccccgacctgaaccacttaattatctgcagcatcggctttacaatgagcaatggaggttgtccaccaaaatcattgccgccaagcacatgaacaaacatacaacgatcccaaatagtatgttcatgggcaattctattactagatcaagacaacctcaagattggccacgaaagtttgaatcttctgctggtctcagcgctaacaaggcgccactaccattagtccaacgaagatggagggagtggcatttatcagccatcacattcgtgccttgcaatcacctgcctacaaaaggttgctgtggctaccttcacctcctaccttggctctggcggtgcccgcctgaacttcctgcctttcatcgatgacaagatcgtcttcaacaactgcacggcccgctacctcggtggccacttaagcaacaagcccgcaccatcctggccggcggctccaacaatgtcatggcagtttccaatgtcccgtctcctaatcgattgtctatcgccagtcgcgaggtctgaccacctaccgcgaccattaccgaggcagcttctccaacgtgcccctgtccccaagtcggcgatcaacaagttttaatgctcgctggcaaatatacgtcggaccacgatgctctcttggtgggtagcaccattgacggtgcggttcacgagctactactccagttatcttgtctaatggcgatgtcggtgatatccgtgaagtaaactgaatccaggttaaggtgtgcttccgtcaggacttgtcgatattggtatatgttgagacattcactacagccgggcagctgtcagcttatcctttgcctgtcttcctgcgtggtctctgaccacccacctcttccaacgcacaaccaaccactctcttgagatcagatagatcaaatccctatgtctttgacccttcgtcttgacagtatatcatctgttcaaagtattagaccagcattgatctgaggctcgggtcgactgtagatggtgaaactcctggtagaccgaatctaaatatctggcatgaattgttatcgcgcgacacgctttctaaaagaggttagccgtccgcgttgtgctgtgcatatgacaaagtggatgattttgtgaacgggaatgccgtgtcgccccaccttccgctcgcagcatacaaggcaactgtggcgcaaaggtgatgtaacgtagcattcgcagggtaagtcctccattggaccctgaagtggtatcatcctggctaccgggggaagccactttcgccaaatagaaattcgtgatccaacaccaccagagagactaaaaagataccttgacggccaagtgtccttacggcacgggcgggtatgtcctcggatgatgattgtgctcccgtcatgtgaaagcggagatgcggagatgcaagagcatgcactagtaatgtgagttttattcgaggatgtctacttcatccagtgtttagcttaccagttatcttagaaactgctggctgctgaatttatttgttttcttgaggtgtgtttattatgccacgctcaaacggtcccggttgcggatatatatttccatactatctaacaaacggcagcactagcactcgtagtaccagttacttcgtggtcttattgtagcatgatactactactttaccggtgttactcactgcttgcgaatcaattgaaataaatccacatgactcgtaagtacttgtcctaggatagggacaaattcctcggtagtttgctcaattaagcaattgatactggctttgatccactgaaagcacggcctggaggaaagaaaccaacagaatcctgttgatatcaaccttgagaaaaaattagtcaagaccaggaaaaagtactaggcaatagctttaatatgttggtttggcgcatatatatgtacgaatccggtggtgaacaacgaacgcaaaggggtatattaaataagagtctatctataatacaaatctatacatatatacaacccggtcatgaggaagcagtagctcatgacccaaattaggcattattggcgcacgaaaagctgctgccagagctgtcactagagatcgagaggccagagacccacagaccacagacacagatggtagcgccaatgccgaacaacgccaggttggcaagagtaaggagcgttttgcgaaccgaggtgaagtagttgccccagtacatgtacagccagaagacaccgggcagaccgactgaaaaattattagtgaccgagttcaatgatgaagtaggaggattcaaactgtatgggagactcacatgaaaaccaactggcaaacaatgcgctgaccaagctgacgagatcgctaaagacaggaatggcctcggcaatcacccaggcaataatccagtagcccgcagcgagcccaatccaggcaccgatacccagggcactgcgcttgtgcatgacatccgtgccgcggaagagacggacatagacgttcttgatggccacgtgtcccaggacgacacccgcgatgacgatggtggggatggcaatgccgtaggcgaccttgcgaacgacgataccggcagagcccagggcgggggaggtgacgttctgaccggcgtagcggtagatgacggcggaggcgaccgtatagaagacgatctcgaaaccctgcaacatacagagggacttggggaagtccttgggctccttcatttcggcgatgaaaccaaagaaagccgggtgaccacctggagaaggggttagttactcagatgcgaccggatgacagtggacataggaaagggagacgaacagtaggcgaaagcgatgttagtgacagccgagaaacccttgacgaaagaagttgagcgggtaagctgcatgggcggagggttcggatgttcaacggcgacaccaatcatggtgatcaagacggccgtgaaaatactgaggaaggctgtgtgaaagtgttagcacaatataaggagactggggatgaacccaatgagatactgacaagtgacagccagccatgagacgttcttcatggtacgaggaagagagcaggcgaaggaaagcaccaagccgacgacgccaaacacgacagagcaggttccgtggttggtaagggtgttcatcataacggtgaaggtcaccaagtgnctgccagatgcaaacatgaagaacaccagctgagcaaattccgtgaacatgcgaccgtagcggccgcacaagacctcgccggcatccgccatgctgtggatgaaggggtatctggcccggaactgtccaatgacgtagccggagtaggtggcaatgatgcccatgcccacgataaggatgatggcactgattgcattactggttagcgacagactgggcgggcgacgttgaaggcacgcgatcgtatgctacttacggaatcaggccaacctcagccacggtggcgggcagagacagaacacccagggatacagtctcggcgatcatcactggagagaaaggatgttaggttacatgcacaaagagacaatattgatatcaaagtgggggagagcatacgcatgccagattgcctataaagagaaagaatagttggttagtctctgccatcaagtatatgccgcctagtatcaacggtcgggtatagttcacggggctcaaacataccaccagtcgagagtcttatagtgaacctctcccacagcttcatttccaaaaggatccctctccacggatggcgtcttctccatatcattctcccacatgcccccctcttcctcgacccggcgagccggtccattctcaatatccttcacgtccaaggtcgacatggttgctctttagggacggttggcaggctgactccacgagtagaatgagatggatggaaaatagtgttgaacaagcacccgtctcaaatctcaaatctcagcggcagcagcagcagcagcaacaacgacaagtaaaggagtagcggaactaaacccaggcacgcccgcacgacgcgggcgtcaaccatatatggccacggcctgaaaagcattgacgcatggcgaggaggtttttcttagttaatagaagggtcgcattggcaaatcagagggcgcctcaatgcaatctctgctggtgtgacacaaactttgccgcccgcagaatcctgctccgacatcgggctcctgctgggcctcgcggctccaccggtcgcaccatgcatcgttcaggcacaaaaagactctattcgagctaaaaaaacgtccagggactatctaaagatgatcgacgaacatcctgcactgtttttagacctcgattgcacaagatgcagcaggagcatgctggtccggcaccggacctgggggaagcatgaggatcaaattaagctcagccccggaaatgcaacttgcgtcccctcttttcctttgcaatccggccgccggagggagaatcgtagccactaaaccttatgcagcgacgcggtggcggattccaggttccccatctcaaggttttccacttttccgccttctcccgcggcgttcttggttagggctggtggccagacggaggccttgcccaatcaggttaaggttctgggttctgaggcatggcgcctgccgatacttcggggctccctggcagcactccggcttgcctcccgttgaatttgtcgaacctggagaaatcgaagtttctgaagaagcccgcgaagccgatctgactcgttcgtctacagcccggtttgccgacccgtgacagctccagccaaactagccatgatcccaatgggcctggatcccattttcccccatccatgccacgtgctcccatctggcggatccccggaatcggcggcgcttcccttcttgccctgactcatagcgagcgagcactttgcagcctcacgcacgatcttgtccgtggacccacctttccatcggtgactatattcgttttgacagtgtctaccgtgcaccagtggcaaatatccccagttatagaactttccccgtcgtgacgtgcgcctgactcatacagtgagccgatgcaaggaggccatggatagcagctttggtgatttggtaagaggctggctgtttcgcaatttgctgctcgttggaggactacaccctcgaattttgctatgaaggaatgacgtattcatgcactggaccgaggagtcgtgactcatgggcagtgcaggtaggttactgacgatatttagttcattcaagccagtggcgctgcggacagtcaccttcaagtaggaagtatcactatccttaaacatactaatatcacccctaaggcaagagtttcacaacagcgtcatcttgaatcatgcactggagagggtgcaatgtacattcagctctcactcaagaagggcgcttccacaagcatctcaaagagtacatgagtatgtttgtagctgggtattggctgttcgctgacgggctatctgatgcaaattgggaaacaacgctgacagatttgagattgcccgattaggctgtagcgaagatgtggtgcggttgaggtagtaagaagccgtcatgttgcagtcgcttatacttcgtgcatcagatgcaaccattataagtagccattgtgagcatgggcctccgttccacgtaacagattagctgcttctagtcgccctacgatgtttccaccaagctttccctgtcgctttcgatcagatcgtaccgcttaagcttttaacgttgttaaccttcgtacaagaagactggctgtgcaatagccccgcacttgttggtcgttaacggtgtcgttgcctgacgtgcgctgtcggccttgcctatacaccatgcctatacaccatgccaggcctctgcaacatccgcaatcacagtctttgtcgcacaagcttcagtgtagtgtactctagtcaaagctgcagtactacatgcgcatattagggtggatggatgttagtaaatatcttgcattgatgaatttggatcctattatagaccgtatgtagaccatagtcataagtagtaggctaacctagcttaacagaaccctgtgtatttgctgggactccagtcaaactggtcaatgcaaaggtaagttgatcaatccctggattacccctcattaagccggaaaaaagcccaagctcgtgtgaatacaagatgtgtatgcatttaggagttatcttgcaaattctccaagatgcagtgagatgccccaagctcagccaggcgatgcacatgaaatatcggatgaaaagaatggtggtttacgttgggtgcatggagagcataatctgatgtcggatgcagcggagtcttacgcatctgcatcacctcggatgtggtagcaagtgctgttatcagaagtctaagtaagttgtggcaacacgagcgctttattattgacacaggcttaccatatggtcctgtcactgctgaataagggggactgttgtcggactcactaagatataaagagtccaaagatcactcactgaatagccttgccagtattcagttcatcgacagcctcagcatctctcccggatcaaagcaaatcctacctgataatatccacagcaacattcttgtccacggactgtcttgcaagaatggaggcgtcccccctatctggtgataatggccacaagtttgttggtgctccagagggagtggatgtgagtggtgactatggcacccccagtctcctcttcatctactacaataagccggtctcagacaagcaccggaaggaagtgcaagaattgagacatgacctggagacttggaacgcctttgaacttgggcgcgccgaatcccaggtcaacgagctgatgcagaaggggaatctgccgaccgacgattacaacgaatcgcgcgtcagacgtaccgactatcgcagcaaggtgatacagtatctgcgcaaggaacacgaatcatggtgagttactatattcagagccaatgcccctgaactcggtccactaacgttccgccatgaaggctggtggaagccgacaagaaggaatttaccgttgagctgaagaccgacgagaggcacatgaacaagaaggtcgaacaagagctgcgcgggcgattggaatccaaggaaaacccgccgtcgcagtttggtgtcgtcttgcgcatcatcaaccgcatcattgctgcacgcaagcgagacgacatgcagcagtaccatttcaccaatgtggaagtgtgtgccgatggcagggacgatccaggtaggcagatatttgtatcctttcggtgacacacatactaatggaatgtcatagttgtcaagtcaaccatgttccgggtctacgaagagggtgaagaggatgacgaaggatctgtcaaagtcaagattgactatgtcaaccatcgctgccagtttaatagggaacattgggccaaggcacgacacaatgtcgaggactttatcaaagaaggagagaggatccgccgggccatgacattgaacttttgtgtcgatgcctaggtagcactaccagtaacttaggaagcctgggtcacgtacaggactatgtggatagtcagtgatcatggatggattgagcggatttgaggaacatgatattcttggtgggttgagagaacaaatgagcatagttttgacagaatgaatatgttatcaatttcggggccagcatgacatatggctaccatcttgagaacattcagccaatttattgttgtagccatggaagcctatgccacattgatgctaccaaggaactgctcaaagttgctccagtcgagactatactgcgtgatcgtctgcaaagactcttgccacaggctcgggctatccgaagcagtaccatccaggtcgctgttaagactatcgacgcaaggtatgcgaagctgtgagggcacatggtcaattcctcccccctgtgccaagcccaacggtgcgacttcattttcacctcgttcccgaagttgcccgttcgccagaacggcttcgtcgaacttttgaagcactgcattgaacctctgcattgtcggacatttcgcgtttacttgcattatggactgcaactttgtcaccatgcactgaacatctttctgagctgcaccttcaagctgccacaaagacttcggaagatccgggggcatgacccacagccgacggaggagcagaaccattccagccgagtacccgtagaaaaggtccaggccagtctttccattgaccccattggcataatcaagcaggacgagaagattaacaatgcgcatcgctgctgtgacgcagctagacgccaggtgctcagcgctcttctgcacgttttggaaactatctctcggtagagtccaagggtactgctgcttcgggttctgccttcggctcatcgaaattacagtaagcaaatatggccgtgtaagctgaataaggagattattataggttaaatggaggagaaccgttggccgtagttggtctggtggatatctggggacgaacgctttcagcactgccgtcgagggggtgatgcacgtatccaagatatcggatggtataatgagataagttggtatctcagcttcccaggttttaaggttactcaagagtgatattggatcagtacattgcgtatcagcggatgatacaggtgaagcaggccgatgcaagaaagcgatcgcatcgcggagccgactgacttgttgttgaaggtcagttgccacctggtgatggctgggatgaccgagaagggcagtagcagagacttcgggagccggtcccagggttacctcccgactgtcgatcacacttgggcggcccaaacataagcagagaaattgctcaaatgtaaatagcgtagaccagactcgccttctggagtcttgttctgttaggcgaaggctctcgtcgatatcgctgcgatgcaatcccaaagcaatagcaatcctcgcagcactaccagttagggtccacgctgcattccgatcattgttgttgtgcaggaagagtgccataagcaacagggcttggatattggagaccgtacacgaggtcaataagccggccaaagctcctcgagcgaggttccagcagcgagaccttagcgtgcttagttcatcggcttcgaatctagcgtcatcatccaggatccagcagccaaaggcgagaacagcatggatacaggccacccaaccatcttccaatccctcagcggggccgatggggtagatgtaggactcgagcttgttaaagaagtatcccctgtccagtagtgggaaatctgaatttacagagtgaaagaaggcatgtattattgccagcagacaatcccggggcatttcctgcaactgtgccttgacaaacgataattcttcatcgcgtgcaagtggcgtcatgcctgtactcactgctgacggtgacaagcgactcgaatcttgtcgagcttcgagagactccgtcagagtatctgcagcgaagcaagaggaaggctgttgctccgatacaaggctgcgaagatccgcaaagaatgcaagggatgctgacggcccgatgtaatgactatggccacggctgtctttgaccagctgcggtgggcgctggctggttctgatacaccctggctgatcgttgctattgctagcgcacgtcagggtctgataggcgctttctgagctccgtagctcaactctccgctcattctcattttgttgtggaaggtccagcttgggcatttcatagccggctttccggcccagctctaacagagcagaaatactatcaacgggctcacccggaaacacccccttaacgattgcttcaagacagtgaatcctacaagagtgttaatcagccagacagtaaatccagggaggatcagcgcggcataccgatcgcggatggtctcgacacttccgtacagtcgtgtctttcgctgatagctggatacgcacgggatgccagatctttggcaagcgacacagtcttgatccgagcctccgcgacgaatacatttgcagcggcgctaatacatcgtggttagcataattctgacaggagaagagccagccaggcaggataaggtcgccacttgccttccggcaggtgtcacagctcgcgaaagtacgtttccgcaactcatcaggaacacgacggctagctaagcgtttttccatacccgagcaatagactatccaggaagaatcgatccgcagaaagcatatgaagtggcgggtgatagcccgattgaaggctaagacagctcgaccggcaaagggagggggatcggcggatgcatgcacccggaacctcggatagacttgcattcactcaaagcttctatgcttggcgtcccagcagttgtagatgttattgaaacttctccaaaccttggataacacattcgctaccctctacactgtcctattcctgggtattgagtcctgcggtataaccagcgcggacatatgaacccaaggggtcctgccttgtttcacaagccggatacgaacatggcatctgacctaaaacaattgccatacaaatcgcactgccgttagacgaactttatggaaccaatcctcgcgtcatggaagcgataccataaattatgcagacaggatgcgaccgcattgttggttggactatcggctcgaaagctgaaagtagtgccgtggtggcttataggaaggtacatatcgactatcccgaagcccagaatctgaatctttagagtaggagatagaagctctctgtttgagggtaccgcacaagaacacctcacctggagctaattccaaaattacttgaagatattattcatataaaaaggcaatgaaataaacaaagaaaaagaagaagtagtgaatggaatagaaaaactttgtattatatttatagtgaatagaaagcgcagcgacatctgccttctgcttatactataatcggaataacggtgagtgaaagcctatcgatctgtgtagccactgcgctggaagttaacaagctggcttaaagaaacttttcaggcatttgtatagtcaaacacgctgaaccgcaagcatagtcttctcagagcagttcggggctcattagaatagcatagcatcgattgacacagaaatacccaaaaaaagtggtcgacacagtgactatcgactcatacctgaagcacttgattcaactaacggggttaagaccgaaaatcagctttgccaacaccattcctatcgttaggaagagtaaaaaagcttcacaggtcaacaatagtaacaaaaagcacctgcgggcttccctaccgtaacgcctagtcaagcgttgccggtgggtacgcggctgagaggaagagccaggcatattcaatcaccttcttttcttcgcaaagttctcagaggtcggtatccacagatgtttcacttcctgcagccaaggagcgagaatcccaaagcagccttgctagcactataactatgtataatatgcacaggaaagggtgacaggaggataagagtaagcaacagcacctgaaagttccagtatcgaaaagctcagtcaagcgttgccggcgggcacgcggccgggagggagagtcgggcatattcagtcacctcccttttctttgtagagctcaggtatgtcaacgtagggttggcactagctatgataattgatagaaatgcaaggaaagcatacaagcgattggttatcgcccggcctttgagtgggtgtacgtatccattcttgtctccatccgccgttcatattctcgtgtctcattatactgcagctcataaaaatgagccatatgggctgggaattccggatcatactactaagtatgatgtactgacccgacgtggctgagatacatctgctagtccataaccacctgtggtgttgccttccgacaaagatgacatggcatttctcttctcaagctaggtggatcggttagcaaaaggcgttttcagacgggacccagtgtccatatggtaggcgcggcacctccctgatagcaggcgagacggagagagcacggatccctttcaaaacagacttgatggcttgatccggctgtgtcattaattgagccaatgtcagctgacaggatcttaaagtgctagattgtgatagatgggccatagtgacgaggcgcaagcgctgcggtcttccttttcggtattcatgtcgaacccggatgcctgcttcccctatccgagggcttctgcccaggacaccaaccagtgctgcaggttgtcgcaataactcacccatgagatctttcataaaaccacgacagatagctactgtagcattgatcagtgaaatgccctcttaacactacaatgtgtctgaaatttgaacccttgaacatcctgatcgtgggtgctggacttggtggtctgtttgcatccttggctctgcgccaagatggacaccgaataactcttctcgatgcatctgctgaattcaaagaggcaagaatggaatcgctcacttcttcctggagcaaggttagctaatgcgcccatgaataggccggtgccggtatccgcatcccacccaacagcactcgccttctacgccgatggggggttgactttgacaagatgcgaaaatgtgtctgccaaggatatcattttcgtcgctggcaagatggatcgacaataactgaaatcaatcctgaggatatgatcgcttgtcacggtgcaccgtattatctggtccatcgtgctgatttgcatgcaactttactagccgtcgcgatcgaagccggtgttgtcattcataagaatcgacatgtgacctactatgacttcagcgttccaattgctgtcacagcagattcggagaaatggacagctgacctcataatatgtgcagatggtaagacttcatttacatgttggtcaacggtcgctgatggaaaccacaggaatcaagtctactgctcgaccgcttctaacaagtcagccagaccatcctcgagacacgggcgatattgcatatcggatcctcataaacggtcaggatctactggccgacccggatcttgccggtctcatcacgcacccggcaacaacgtcgtggtgtgggccagatgcccacctcgttggctatcctatacgagatggtgagctgtacaacatagtcgtgtgtgcgacatcgaaaggagagacgacagatgagatttgggttgtggagggcgataatgaggagctttgcgcgagattctccggatgggagccccgtgtgcagaagttatgtcgtttgacaaagtccttcatgaaatggcgattatgcgaccttcccgcactttccacatggattcatccgtcaggtaaggcttgcctcttgggagattcctgccatccgatgctaccgtatctggcgcaaggagctgcccaggcggctgaggatgctgccacgatttgcagggctctggctgaggataccgatatcacaagcgctttgaagcgctatgagcgtatccgcagccccagagcgtccttgatccaatctaagacgcgagagcaccaatacatcttgcatgtcgatgacggtgaagagcagtgccagcgagatgagcttatgcgacacgacagtccgtctagtccaatcttctggggatacgagctgcgtcgggaatggttgttcagccacgatgctgaaaagatggaagaggccactgcagagccacgattgagaacagctgctctataaggggtgggggaagcttagatcgcctagtactaatgagaacgtggagtactattttatagctggaatttgaagggatgtttgtagtttgaagaaagcatacttctcggtctatcggacatcggatggcaagggcaggcgcagtccataacattagagccaaagcatttgttccggatattgccatgtagttgaggaaactgacaacatgcttcccataatgtaattgcagtccgggatttccaagcattggcttgcaacctaccttgccacctgcacttgcaaccggtctttgcaacctggttgactgtcgatcacttctccctcaatgaatcaggagatccatttaccacttgcggggaccccgcactcctcggcccatctcagccggatggctgcttccctgcagtccttaagaatgtttctcggctcgagcatggtcttgattaagaggctatctatgattcattttctgtcaaacaaaggtggaggccaacttagcagacatagcatcgtccaatatgactaccaatgtcccagccacgcgcaaagtggctgtctgcattgatacccaacacattgaactcgaagaacgccccatgccaacaccaagtggctcagaggttgttgtgaaaattcaggcgaccggtatctgtgcgacagatctgcacctcgtgcgacggactatcccttatcttcaacggaaggtagacgtctgtggccatgagggtgttggacatattgtcgctgttgggccggatgtagatacttcaaaatggcacatgggagaccgagtcgcccaccggtgggtatttgatgtctgtctaaactgtgatatgtgccaaggagggaatgagcagctatgcgactcgaggaagctgagtgggaaggatgtggagggatgctggggaggtactaccccatcgataatccacgtcctgcatcctaggcataactgagatattgcagagtacacgattgtcaattcgatgtatctcatgcgtatccctgaagatatctctgcagctgaagctgcgccgaccctgtgtgctggtatgagtgaaagatcgcatgcgggtgtgcctttgctaacttaagccggcattccaggcacaacagcatatagagccattcgcactgccggcctcacttctgggcagtggatagcaatcgttggagctggaggtgggctgggtcatctgtgagatgtctcaaacgtgaatcaacgggtccatgaacgctcacctactgccagggcagtacaatacgccaaggcgaatgacttacaggtcctgggaatagacacaggcccaagcaaatgggagctgtgtagcagactgggggtcacttcatacattgatttcatggagacacgggtatgcagactgctgaccttagaggaatgtagctgacagatatcctgcaggacttgacagcagatgtcactcgtgtatctggcggaggacctcatggagtgattgtggttagctctagcaccagggcttatgaacaggccctaacatatgtccgcaaaatgggtattatagtctgcattggaatcagtaagctacgatggtacctccgggctacaccacaggctaacattccacaagcacctaataagatgcacttccctattggcccagaatactttgtggctcgtggagttcgccttactggcagtagcaccggtacgatggaggatacgtgtcaagcactgcagtatgtgcgcgatggccgagtcaaacctattatcgttgaagcccggttggaggaaatcgaggcgtgtctgcaggcactcgagaaaggggaggcggacggtcgattcgtggtctcgttttcttaagagttcgtcgctgggctctaccggtcattcttgagtatagctgccaattatttctaagttgcctcatctcgctatatagtccagtatctaattcgagttttgtcttgccctgagctgacgttacatgtaactgtatcacgatcataaaggatgcttatatacagaagtacccatatgaccacagatgtaagctatgcacggatattgattcagttctcatccaccagacagataatcttgccggcgttcacatttgactccagacgtttatgagcatccgatacatgcgtccatgagaacactttgtccaccgttgtcttcacctcgcctgatttgatatgcggaaggatcttctcacaaaatagatcacgcaactgtccctgataatcagccgctcgagttctcagcgtggtagccatcagccaaattcgcttattgagcagtgcacgcaggtcaaagtcgtccaccttgctcccgcttaaagcagcgaccaggaccatgcgagagtccatggctgctgaggccatgttctggtggaaatagtcccgtcctactaggtcgacaatgagatccacgccgcgtccatttgtttctcgcttgactacctcggagaagtcctctccagagcgataattgaccgcaaagtctgctccaagggagcgacataattcacatttctcatcactcccagcagtggtgaagatcttagatgcaccgccggctttggcaatctggatagcggattgaccgactccagaagcaccagcgtggatgagtactgactggccaggttgaaggttaccgactagatggaccgcctggatagctgtgaaggaggtctgtccgatcagtcggatgaaaatgaatgcggtaggggtaacttatcctacctctgggatgccagcagcttcttcgaaactcagcgtagggggaagatgcatgagcatcttctctgacacggaaatcttttgtgcatactgtatcttgtcaattgcatgtccctgcactgtgcgaacaatcacatactgcccctccatatgcaagaccaaacaccttgtcccccacttggaaatccccggaacctgttgttgtcagctaatgccctcgcaatgccgaatgggccaactcacaattggggcccttctcttccactatcccactaaactccacgcccatgatcttccctgactcaggcaacaaaggatatggataccgatcctccctctgcattatgtccatgcgattgagaccgaatgccttgatgcgaaccaggatgcgattacccgttggaacgggatcaggcacaccctcctcgatgaagagggcatcggcattgcctttgccgtttctgaccccaatggccttcattttgacgatattgggttgtagtgtgtgaacgctgtagaatgaggtaaaacgctttcaatttacaaggctatgcgaccggcgcgacacagagataataatattaatgataatgataataatggcaatggcgcatgcgccggatcgaacgcatccccgctgacatcacttgcggggacaagacgaacggttttgtggagttggaaatggaccatgacttgccactttccgacgcggttccacagctccgtctgacggagaacaaccctccgtctctggatctgtcgctccgactggctcacccagtgtaatggctgctgccaccgagattcgatgccttctggaaacaggcacgtggagggggtatataatatgccattctcgggggtcaaccgatcgactcgtctaagcatttaatcctggtcctatttctcttccactaaccgcgtttgtcatacacgactcagtacctcgatatatatacatatatatcaatataatagcgctcaagggcattcaaaccatggccacgactaccgtcactgaaactgccccccagaacggcaacagcgttgcatcagcttcgaccagcaagttcttcgatgatgtgcacttcctcggtgacaaagagggcaaggtcgtgatccgttcccctccgaccttcgccaacattgaagatgagcgcgcgtaccagaagcaacatttggccgtggccttccgtgtcttcgcccggcagggattcgatgaaggagtagctggacacatctccctgcgcgatcccctcaaccctcgtcagtgaccctgtcttcccccacagcaactaacgagtaactaaccacctttacgatagaccacttctggatcaacccactcagcatgcacttctccatgatcaaggtatccgacctcgtcctcgtcaacgagaacggcgaagttctcccgggaggcgcccagcaccccatcaatggccccgccttcgccattcatagcgaaatccacaaagcacgccccgacctcaacgccgcatgccacgcacactccgtctacggcaaggcattctcctgctttgcgcggcccatcgaaatgctctaccaggatgcccttcgcttttacaacgatttggctgtgtaccctcgctacggaggcaccgtgctgtctaccgaagaaggagcccggatcgccaaggccctcggtccaacctgtcgcagtgtgatcctgcagaaccacggcatgattacctgcgggaggacagtcgacgaggcagcgttcctgttcattgcgcttgatcggtgttgtcacgcgcagatgatggccaatgcggcggccggaccggggtgggagaaggtctacatcaacaaagaggaggcggagatgacgcataggaagagtgggaactcgagtaagatgtggttggccttccagccgtattatgatcaggtggtcaaggaagatccgagtgttctggagtgagctcattcagttacgatatgatgtttttatgatgttatgtactttatgtgtttgattgaatgtcggttctgatttcgaagttaattcgaaagtgaggtccatatacaggtcgctaatagggtacaaccccggtgaacatggaggacatggacacgtcgggctcgttcatgaacccgaacagcaggtccaggtcctgattgaagtcctggaagccagagatgtggttggcatgatcgaagtcgcgcagggctgaaatccagaccgggaaaggtttggaaatctaaatttatatctacctggaagggatcctgaatagccgggtcacatcctgaacgtcgttagtgacttcggggtttgctgaaaagtgcgtaggctccttaccagtctggatggacatgccgttggcttccatgagccggcgaatgatcttcgacggcgctgagacgccgcaattggggatggccagctcgtccaaacaacgtaaacatactgtcagtggagatgacgcctccttgcggcgtgtgctttctcggatggccggattgcgcgcatgaatggtgcaggctacatataccgcgtagctgagcatgtagttggctcgacgcagggagtaggctgatcgataggccagcgccaggctggtgatgttgcgggcagccgtgacacaacgctcccaagagtccgcgggcgggtcgtcggagcgcagatgcccattacccatgaacggacgatggagtagaatgatgagggcattgtaggtagttagcaggataatgacattaggtgctacagtggcgtgcggcgattggccatcatctgcccagggctcaaatcgcagctccgccggcaatttacgataccaaatctcaagacgacggtcaataagctccagatgcttgcgtgtcttgctaccagtggcaccggccatgtagaagcggtcaataatgctggtcataatcttagacagagaacatagttgctgaaatacggtcacggagtaaatgcgagtggggacgtgagagcgggcagtattgtctggcttgagggggtcgatatacggcgtccataactcgttctcttcaaaggtatccatgaagtctcgcgacacatgcgcatcacgtagctgaattgtgaaaggtcgtccaaaatacaagctctggagcttatcacagataaaggctgcccaaaagacacggcgtcggacctcgatatcctccgcactggcagcaacctccttgcagtccagatgcaagccgaggtcgtataccatgcgcagagcaaatcctgtgtagagccagcctttggaagtctgtccccgggcattgaaggtgctgccaagcataattaatccggcaatggtcgggatgctcgaatgcgtcaacagcgactgttctgccagcagttgatcacacctatcgaagaaccgtttgccagctgattcgggccgttgcgggtcttcccgcacctcaatgcgtgtcgagaacttgctcgaacaagcgaagacggcattaagcaaaaagtccgagcagtacgggccgccagtgacgagatcacgcataaatgccggacgatatgttagcaggaatgtgtgatgctgccggttccagtgcagatcgagcagatgcaaagccaactcggacggtatccctccaatggtcggtagacgacgtagatcaggctcacgttggcgctggagggcggcctcgacgataagttgatatcggtctggctctgcagcaggccgtgagttggcactgttggctaggccgagagggctccgggcatgcaacgccgacgacgggccaaagatgccgacagtgccgcattcgtcccgggaaagaaaggtggtgggatcgtagtcatcatcttcggagctactctcattcaactcgtcattgggcgtactgtacacgttcgagctattgtccgaggcctgggtgggttgggataccggaacgtcgttgatactagcaccgaggctggccaatgatgccggcagttgcaggactccgtccttgacatgaatagagtcaaggatagcagttcgagcaactggatcagccttcttcagtgcaataatcacgttttccgccgcacgcctctggcggtgagcggcattgatgagagcccgggacggcctgaagcagcagcgtcagcgcatgcgtggcaagatgattgcagccaaggatggcgagaggcgtccaggtgggatgaacacctacctctggcggggtgggtcgaccacatagacacattgtcgatcatgacgctgacaagagccacaggtgggcttctcgttgtcacaacggatcttgcggacgcgacagaattgacaggcccggggggtggtcggagaagactggcgcttgggactcatttccgcacatggccgaccttgctcggagaaatagacagttagaaggagatgagaggggagcggactgtaaggcagcgtgggccaggacaggctaattcagagacagcagggacccgataatctgggggagccaagagcagctagttggggccacagccagcatgacgcagtgtcgcgatctgacatctgcggggagaccgttcagggagggaattaagcgaaagaattcccgagatactgagcttagagggtataatgaacaacgggattggatatccccgcgctgtaagctgagcagggggtaaatgttgaagtcgaactgagggctgccactcagtcccggttccttcctctttgggacgaggggaagtcccgctgactaattgcttacaacacattgtgattggccattgggtcacggggccaacgccatctcacgctagctgtttacagattgaggtagcggagcatctcggtccgtgaattcccggcatgtgtaggccagcccgtatcaactgatcacaacattcatcctcgatccacaattgtccccacttgccagacgctcagatccccgatcgcttgagacattgaagtgagagtcacagcgaggtagcactgtggttgtgctgtatcttttccattcaagttcaccaatattgtcagtgtacgctgccagctgcacggaggatgatgctccgttagagaggacccgcggcagtcctttgtacagcaatgaaaaggcgtcgtgggggtagaaagatgttgacggccaccctgtgcaacaatccagttcaatgattttttttgggtaacgtcggatggcatcgatgaccacagcataactcccagttacccaggaggagtgtcatcacacccaagactatcaggtacataaactgacttttgagcatgcttggtacactgctaactggacctcaccaaagtcgaacatctcatccacgaaccccttggtcgctggtgagctgactaggggtgccgaagtaacaccaatggcatctgtcgcccttcgcgccaccctctcatattcctgctacaccattcatatcttatcgagtgcgccaagacatgtttgcaactggccggagatggcggggatcgaaaccccgttcggtctattctgtcaggtcatcgccgcagatgagctcggagacatatatacgggagctggagtctgctacactggaccatgttcgaggcggatgtgcggttcctatctttcaacatgatccataaccagttggtggatgatgcaaggcggttataaacaaggaatggcattctatctgacatggccgtggtgtggtctccatgacagttgatcaaaaggcaagccggccagtgcgtgtgatgtcctacgacatgctcaatggggcttccaagcagagactcggtgacctcgacagagttacagccctgctgccgggttcgctagccggtatcatgggtaggggtattacatttaccgcccacgagctattcgcctaaacattttctctgcggtttagcagaagacacaggaatgaccaaggactatctgacataggaccaggtaagatataaacaatacatgttctaggaagcatatctctggccataactcaatgcttgggtgggaccccctcgatctgtgctcggatggagtctgtcaccaattcctgaaggcccttcgtttccctcacgccaatatcttcgttatcccggcgatcgtacagggtacctccctccgaccagatgcgccggagcgtgtagaccgtagccacagggtcctccttctcccacgcctccttctctaatgcccgcagctcatccagtggggtatactcaacggtccacttaacaccagtctggcgttcaaactcggccaagacatcggccggcgtggtagtgaacgagttgaccttcagtgcgcggttgcgagcggcatcccaatgtgtgagggcgtgcacgacaaatttaccaacactatggctcattagcaaactcgagatctagacgaggattttccattcaagggccatcatactctgaacaggctgtgagactgattttaccatgctcatcccccacaatgaccgctttcttggccaatacatcgaaagtgcccgccttggtattgcgggatcgaccaagataaaacggaaaatccacgtagggccctgtcaccacgtaggcatactccagggtactacggacctctctgagagctgcgcggaccttcagtttctgttggtgcggcttctcatgctgtgaggcagggctgtattcaatatccgtgccatattcagaaggcaagaagcgcttgatattgggagtttcgttggccagttgaatcagagggatctgggctgcaatggcgccgcgaccgagtgcggagatgacggtgtccacgcctggtgtagtcgattagttttaaggtgcatatgggatgggagggcgagttgcggcaacaatgtacctgcatatgccttgagcacatcctcgcgattgccaacatcaccaatcaggatgtcgactcccttctgacgcagagcattgagctcgtcgggcttgctactgacggtgtgggggctagtgaagatggcgatgcgaccgaaggagtctcgggcgttgacgatagcttcgataatgtacttgccaatggtgccagtagcaccgaacatgagaagattagacttgtcggacattatgaacctctggtatcgtcacaagattatttgaatgtgatgtggttgcgatgtggaagttggcaattttggatttataataaaagcccgtccccgcagcccggctatcgatggcaatttcaccccgcgggctcggatcggcgatccggcgattagaaaccgcatggcagttgatctcactgtcagtgctcggacctatgttaaatcctatactcttggagttactacgtaggatgattacggtgccatttcccactttctcctaggagacttcagatgttgtattccgggtagtttaactaatatttcattggggcttccaaggctattcggtaatcggcttcgtatgcgatagagagataagagcacagcacgcaatgattgatcgtgtcaacacaagaagacgtcatcggggcattcaatcaatgaatgaactactgaaataatttggccgggttgttgacccacaggttctgccaggtttcctcatcggggatccattcacgcaacgtccggatatgcccggcatcgtcaacctcccgaaatccctccacctcttccaaccgttgctggtcggtcttgcctttgcgtgtcactcctaactgtgtatgaggccaatccgtgccgaagataatgcgatccggaccggcctggatcactgccttcgcaatgggctcgatggccttcatgccgctctcgtgaccatggtacaatcgctcaaagcccgagaccttcacccagactcgcttttcccggatcaggtccagaaacgtggcgaactcagcagagtactcctctccggggaatgtgcccccaaaatgatcagccaccatctggatccgggggtccatgttgcggatcgtgtccgccatggctgcccacgcactgacagggcagaagatgccaatagcccatcccagccgggccagccggtgggccagtgcttccactttcttaatgatgtcgttgccgccgctctgtttgccgtggccccaggccatctcgtgcaatcgcgccccgcgcactccggcggcatgtagtgcgtccagctgttcatcggtgacggtgaagggatcgatggttgccaggccccggagagtgtaaccgggcatctcttgctgcttggacagggtatcaaccaacggggccggcgagaccccttgtatggaggcgtgaacgatcactatgttcttgcatccggtgatgaccgtcggatactctgccatctgggcggcttgaggtgtatacgagcgtggtacggcataggggaatttcttaggatcgaagacatgaatatgggtatcccatgcattatcggggacgagctcggccatggtgagtgagcggggcgtgcgatcaggtcagacagacgttcggaataagtcttaccaacttggaggcaggtgagaactgaaattgcagtgattctgggcagcctgagctgaaatgaagaggcaatgggccatcccaagcgagatatgcatgcacgaccgacatatatgttgctaccagctgacttcgcatggctgcatcattggttggagcttgatgctccatctgcccgtcccggaccggcgccgcagccgtcgtacggactatcgttgtccgtcgtgccattctgttggatcccaaggacacccaacccccgcaggacgcctgcttctcgagatttcccctgtagatggaaactggggaactggaggatcggcatttgatcagaccatgtcgtggtggcgacaaactagtggtcttggtcgcgcgatacggtgaaaatgtcatcaagaacgaaggggaattggttggttgatatcaagcatctagggctcgacatcggcgaagagcagaaacaccgatgtgggctgagatatttccgatcggtcaaagctttcacagccgacctgcatcactagatctgctcgacgaccgtcatcgtgtctgcaaggttatgccgcaatcttactgtgcaaccggttcggtgaccacctgaggctggcgattggcgaacgatgaggggagagagacatgtcaaacccacctcgctaaggtcaaaacccaaccaactgccagaccccttctattgtgtcctcccccgcacatctaggattccccatacgccaagatgatgccaagtatggcgtcccagattgaggtataaacgttgcctcgctcggggagttttcgattgtgtcctcgaccacttcctcaagctctctgtccacattcaccatgaacattcttgccactctcgccggtctccccagggagattggctctacgctgcacatgaagcctgtccaggcgttgatctggctggcttgctgggcgtgctggacgctgggctctctgcaatactatgccctcccgttcactctcagcaccgtggcggaagcgctcgacgtggcggaaaccaacgtctcagaggccaacaccactacgatgctgtcccgtgctgtaggggcagtcatctttggtatcctgtctgatcaatacgggcggaagattcccatgctcattgacctggttctcatgtgcggcttcactgtcgcaacggggttctcgcagacctttccccagttgatcggattccggttcctctttggtgggtgctacaggtgaacactgagcgggataatcgtgctaatgtgtccaggcgttgcttacggtggtacatatggtctcgccatggcaacggtgctggaagcggtgccggaaaagtcccgcggtgtggtggctggcttcacgcagcaaggcttctcgtccgggtatctctttgcatctggcttgcatctggccatgagtaggctcacactgatccctttctttactcattactcactctctggacagatggctatggttggcgctctcttttctggctctgcgcgggcttgacagtccccatcgctatccttcacgcagtgaccccttactacagcgttgcctctcctgccccgcaagatgaagagcatgccagcggaccagcccaaacttctcgcgcggctgtgggagggaaccttccgttccataagaagctcgcctacgtgctccgctaccactacaaggccttcatctacgcctgctgtctcacttcctgtctggctaccatgggccacggcaccatggatctctacccgaccttcctcgtcagccaacgcaaattgaacatcttggaagagacctgggtgacctgtatcctgcagattggaggtatcttgggcggcgtggtcggcgggttcctttcccacaaggtgagcgctaagtgggtggcggcaggcgcaggactgctgatcgctccgtggttaccactatggacgctgcccacgagatggggacttctcgccctgggagccttctttttgcaatttttctacggcgctgcaatcggtaacttgggaaacttgttgcaacagctgtgtcctcatcctggtatcagagccgcctttactggtgtcgcatacaacatcggtaatgcagtgtcgtcgatcgcaccgacgattgagacgtcgctgggagagcggttcccgactgcggacgggtcaccggattatgcgaagacgcagatgatccttgtcgggattgtaagtatacatgattcccattcttttattttttggactgtaattcgctaataggtatgctattaggttattttctgcttagtgttgaccttgactctcatgccgctgaacagcttgaacaagagctgggaccgggaggatcccaatgccacggtccctgcgacgcatgcagagatggaagtgatcgataaaaccgattttaaagcacaggaggcagatgcagagaggggtggttcgacacatgttgaggatgccaagccttagttccattgttttgtatgctcaagttttacggtttcgtgaggtggaatgaatgtaaagcccggcttcagcgttctgaattgatttgattgataaacaaatgcgcgggctggcctggtgatgctcctcccttggaatgttctagggatcatgccaccttttttcatcctgtaaaattagtgcaggaagtaagttgctcaggaccatggacgaaggttagaccctgtacccgcaacgctcaccctggtcgctcgcacatgcacaagcactgcataatggtagaatatttcggcattagctttgcccctaattccagatctaagcgctgcagtgcatcagttcacctcaaggggtcccttggcaggaaaaagaatgagccgcctggcggggagatgcagcaacggaatcatggattcactgcggcatcgaggaaagatcggcggcccggtggatcaaccatggaacgcgggatttaacgctctctagtactgttgagggggagtcggaaaagggtgtaccgcaagcgctaggcatgggatatattcctgacatgtaactcgttccgccctaacacaggaccgctgaagctgtttgctgaatgaagctgcagcgagtctcttcgtcgcctctcgaggcaagactctgatgaagggaatcgaacatggctctgctctctggtatttgtgagataatgtgaatcagtaagaaagcctagggaagatgccgagaggcggactagaagaccacagaaaatctcaaaggatattagcatgcacggagatatcattctccgacccattcgcgatctatactttcttccatcgccatatttcttcatggacgcatgtgacctatacccacctcctaacatagattccgcaccccgtattcctcaatggcacacaatgcttcatgtaaatgctggtaaggtgttgttctcgatcgtttatcttcaagcaactctttgaggatcggggatcccgttgaaagtctaactcataaaccgtcataagcgttatggcgagacctagtagatatacccactgtatcaactagcactagtcccagtgtaattacggaggtcggctagagtaagtacccatccgaagcgtagctttctggtcctattatgagaaataagtattaaggctcgggattccagaagctataccgtctaagtacagtagcgtggtgatagcttgctgctatcacagagggtagtccgtacaatatatctaatgttgccttaccgatactccagctgcgctcgaatctacgggctcgaaacttagctcccatatggcagcaatgttgttacgtgggaaggaactaattgggcggaccaatctaggggtatcctgacactacagacaggcttcctgttaggctggtgagcaatcatgaatggtccactagcctgaaatgaagagaagtatattgttatgggcggctaattaatatattttgcttcgcggtagatttacagatgatattgtctcagactgtctatgacctgggaagagacaacctgctgtggtaagtggtaccaagtctatctttctcgtcgatagcccaaacagaaatctatgtcaatccaactacttgtacgacaaaaatgaggctatattcaatgtaatgttatatgtacagtgatgacaaaccctgtttatctctgctcaaaaatttcccttgaatagccgatccttaacaaaatattcagtgctggggcttcccacattcgacgtccttcatacaccgaaccccaagctggcaacagctagagtaatgacaggtccttaattgtggttgttgcatccagtgacgtagtcaattttgatctgacaattgtccttgccattatcatcgtccgtaacagtgccgcatatcttacagtcatgggccctaatgttgttgaatgctgctttcatctgctcggtggttctagtgcaccctctaggccccgcaacaaagacaccgcatccaagaccgtcaggtgcaccccagcagttgcccgtacggccactgctagaacatgttaggttagttagacctggaagcatagtatcaacagccttttggcagtatccagtcatgcctgggaatggccatattggctcgagcctttgcagttgaacgaaggaccggctatcaaactttggccaaaaggagtaggggtggcggtctccacgctgtcttcaggatccgcgggaataaaggccgatgccaatgtggagaggaatgggagagagacaataagaaacttcgtgatatgtttgaaaggagcttttggagtcaggagaattgctctagatggtttggaaataaaagtgactcgagggtgtttaggggcctccttatataagtctcatttactagcctttgcttccactgtcaccgaactacgtggctaacaaccaaaagcggagacacgaaaagtgagaacctccctacgcggtacactactatcattcgtccaggattaggttatggtgagtcagaccatgtgcactgctctagtaatattgcacctgcaagggtttgcactagtctttactggccttcgccacctactgttattaacccccacgatgattagtatatagaccataagctacgcatgggtatgcctctaagaaaccacctcgaaggactgaaatgctttgataagaaagccccggggaagccgagaatttacattacggagctatcaaacttgtccgcatagaaccctgtatccaattaggcatatacaactgatgaggcaataagacatgacacagtagcaccttgccaagcgaagcacgcttaattctagtatgagctaacggctttatcggacgcattcttcctcgtcttggtcgctcgtcgctctcggaactgattgatactgtcccgttttcaattcatgagcgctgtcatttgaggttacatgggccaagttcaactccaagacaccagcgcctaagggttgactttccaactatgagagtgagattatactctatggatacccttagaatctacgaaacactccgccgtggcatatattgcctatggagagtcaataccttaggtaatattaagaagattaccaagggcactaaaggagccggcactgcgctgcctcgacgtccggctaggctggcataacccagggtggccagtgcgaatgatggcatcggccggcgtggtcagtcgagtctcaacatcttcaccttcttctttggcttcgaactcttccctttcgattcgattaccatgtggttaatcagtacatgactctggaacacgctgggtcgcatggaaatctttaagcatccttcccaacattggttttaatctgacatccgtgtactcggtgtgagacatagacatgcaacacttacccttctttacctagtccttagccctagtagaaaaacgagcaaacaaatatacatacggcactcaacagggaatctagatatttgcttggctttacactattcttggtatcaagaattttgccgaggtccccgttgcacctctagttctactgtaaggaaggtagtccttacaagaatagatatccacctcctcccagtgcgaacctgagtatatatgggattctaggggtctgcagagtatctgcgggtaatgatagccttatggtcttgttttgactcttcctcttggcaaggttcttgacacctaccaaagaaggagattatagatcactatacaattctcgaccacaaagctgcacgttgcatttgccggtaataccaattccaaccgatactttcatatttaacggataatatttcctagggtcccactatgttatgggaccaggcaaacacgtcgaatgttatagattattttcgttgtggaaccaagacaagcagccacaacatttgccagaagtagtatagtggcccgccccgacgtacaggtaattgctataaatggggccagggctgacatcttttacagatgcgtcgaatgagaaaccaacataaacagggtgcagcgggggtgagaattgtggtaaatagctcggtcacttgtgtactgctatttgcgtctcggagggttgggagaaatggcgaagataaattatactgaaactagggtgaattagtatgcttagaggaactttttcacaggcggatcacatgtgttagatattacatgacaaggggttcagctgagcacgccctttagggcattaagagccccatgcggcgcagtaaccgtgcgtattatggtaagccatttgactaagtagtagtagggcctaacaaggacaaattgatcctttcccaagaaggtacctgtagtgggtccgttaagggtccaaaaggtccacaacaaagaaagcgaagcctcagaagtacgcctctatttccgtagaatttcttaaattgtggatatcgcaacaggcttgaattgtaataaggatgtttcggtcaatcatgcccaacccgggtaattttatttagcgcttcatggagtgatgtgattttatatcacttgaagttggccaactattgcaggtgagtaatccttcgttaccactagcagagacgttgtctcttcccccctctgccctactagccactgactgcttaccgtctgctggggtgaatctctattgctccctgaaatttctgtgtacactcgaatcctttcagtactacacaacgagagaatcgccgatatgtggcggcatatgaaatttagtgccttccacatagtcactttggcgttggctgcgcttcttgggatctctatctggtcactgtggttaggagttaacagtgatagagacaacatccatccactgctcaatcaactaatccccgctggccactgtgcttgccacactgctgctatctttgagtgtgacagctgtcttcgatgccccgcccagttgccctttcatgacactgtttcctcgtcctctgcacctcccacgcgaactttctttgatccgcttgagtattcatacaatgagactcagtgcaccactctcttcccgggcctttttgaagatcccatccgcgcccagtcattctggacagccaggcatggaatcaagaggattgatattgacaatatcaaaatggcagacggcatggctagggtggctatctatcaaggacgactttatgtccttagagctctggcgaagggggaggatcaccgccgtaagattctagggatcttggcttcaattcatcgcgccctcgtctcggctccacagctcgctgtcattctaaacacggaaattatcttttctgttgaagacaaactggaggacgttgctggaccagatcatccgctctgggtgttggcacggaaggctactgaagaatccgtatggcttatgccagactttggcttctggtcttggggccacattgatactcagattgggccatatgacgaggtagtcaaacacgtggaagagcatgagcacccgtgggacgagaaagagaacaaactggtctggcgtggaaagctcagtttcgccccgaagctacgacgtgccctactcgagattgcacggaattacgcctgggcagatgtgaaggaggtcgagtggaagaacaaggccaactaccttagcatggacaatcattgtgattaccggttcatcgctcacgtggaaggtatggggtattgcatcgtctaagcattaccaatatcgacgagatagtccagctaatgtcttctaggtcggtcctactcagcgtctctcaaatatcgccaagcctgtcgatcggtaatagtgattcatgaattacaatatattcaacatcaccactatcttctcgtctcgtccggtccgcagcagaactttgttcaggtggagagggactggacggatttaccgcacaagatccaagagcttctcgataaccctatcaaggctcgcatgattgcagacaacaatgtggatgtatttcgcgagcgatatttgactccagctgctgatgcatgctactggagggcgttgctgcaggggtggaccactgcatcgcctcagatcaccgaaactatgagtgacccaaccaatgtctctaacaaaggcattcggtacgaatcttttttactgctagatcccagcaacatgatgcgctttaggccttgagaatagaaccatgtattttataacttcgttgaatgtcgatcgagtcggtccacatgctgatctggtgagagcggattcctcctatcctccgctactccaataaaccatataaccttttcctagggcaacgtaatacatacgtagaaaaaggctatttaatctgaatgggctgctattttcctcgggtgtcaattttcttctgcctcatcttcctaccttatatctatctgggcttatacccggcgctgtttatttttcgtgaaagatatataataacacattcatggttagatgacatcggaatattataagttgggatccatctagaaaaaccgcaaactcgccgagtctcggggagcctatgagcgttgggaaccagggcaagataaatttgtgcgtgcgtacgtgtgtgtgcctaaagggaaggattcgtgccacggaagccacatattctacgggaattgtgaactggtatttgtagagtgtagctactaagaaataatgaacttgaaacaatacagcaatgcataccgtacagcaaggtctaagctcgaccctcctccatctggacatgatgtccatccacttcggcgaaggttctccaaaataccaacttggagaagttcccaagtcctcaacccgtgttactgcatgttacgcataccatggactcgtgtatagtgttatcaagtagctttgggtagactagggcttctagagagctaggctacctccaatgggactacggcatctgaggacaaacatatcaacgcgggccgttcatgcaagtactacttttgtggtatctagttctaacaagactgcgttgagacgatctcaccatggtctggatttcattcaactcggtctctaggtattcctgctgcgccgcactgaagttagagctgtaccggacaccggggtattataatgctcttttgaccagatgccttgcagccaggttggatccatttgcggacggaacaacgtcggccttgctggggaaaggctaaaatggaattgccagggcatggcgaagaaacagcgtcgagatgaggaacttgatggtggcagctgaattagccatagtgggaaccgactgtagagctaatacgatatagcaaatgaatgtgtgagtgagtaaattcagcagaacaaaatggtgttacagtgagtatatgtttctctgtctgaatgagcgacagaagcgtaaaagaaagtcacctccatgcacaactcgaggaggctggcttttaagtgactttgatgatgcctgtctttccagtggcagataaggcattgtcttgttgttccctcattgctatattctactgaaaatcttatctacccttcccctgctatctccgtaggcttttagtgtttctattaaattatcagtttattacggaacctataagaatccaatctccgaggatcctccaggccaattactaacaccagaacatgcatattgctcctggcgtcaagcggaagatgatatctgatagaattaaatcaagatagcgctgtgcggctgttatcatatcttattagaagaatttcatttttaatacaaccacagtattgcgagatatttgatttattaattaatatggactatgccgacacagggcctgataaggactgtgtatagacccaagctgataaatggagctagagatagagatgaaccggtgtgctattttctggataattaaattaaccgactgtgccccctcatagcgcttctaactggaacccagtctcatgttgcatcactaacaaagccttgtggggttgacaataagaactctaatttagtgttccccccctcacccggggatcatttgacggataaacctcgctgaaactcatgattcttggcaagatgtcacgtaacggattttacgatatgtaaagctagagaacacgctaatctatatttacaattacatactatgttaggcaatatttcagtccatttcagtgaattaaagtatcattataagagtccatcattgtcacgtgattcgtttagattgtaacgacttcttggagtgaaagttgaattttcgtagaatggtgtcccaaaagtgtaagtacaccatccctactccaccaacctggcactagaagctagctcgctcaggtttctcaaagaaatcggaaggagctggaccattaatacactagggctagtgcttatgccaagcagccaatctccgtcggtggccgcgaagtggttgatcgccaaatgtaagagactctctttagggggaaaagtcaatacaaggtcgaccataaggccagcattacccgcagatactctgcggacccctaaagtaccctatatactcaggtacacacacatacaagtggcttgtaaggattcacttccttataccaaacgatctatattcgcaagagccagacaattgatgaaaggtggaaagacttgagagagtgggcgacgctacggttcctaactaggatctttgttatgcgcaatcgaaatgaacagctccagagaaaggggctacccgtggacgaagatcatctactcagggtaatatcaaagccgtccgttatagtagggaacaggctctagtgcgtgtttgccggactgagataagagaaatactgcgtgcggactttgcaatataacagataataaatactatataatagttactgctcggcgctttgtgtgccctttctttagtataagtagctgtggggtcctgcttggtaactggtctatataatacggtatactatttaaaatatagattttctgatttatagatcagtatcctgtagaagtaatatttatgtttctaattattatgtagtagctgagtataataatatatatcaattaaaaaatactattagattttattaatatgtttagacatggcagggctcatctgctggtgccggactcacccgggcccgctcgtaccgggctgagtcagatcctgctgactaagacttgcgggttcagagctgctaacgtaatcaacggtcgaacgggccacacggtcaggcgggccatcctgaaatcccatataaaagatgtctttttgattctattatatatcaaccagtactacttctatgaagctctaactttgtagatagtttatatatataagaataagtattccatgaatttttcagatttttagaatttttactttgataatgaaaccagattcttatataatacatataaatacagatattgtaatatgataagtccataagtaaaagtatattcatttttagaaggtatatagatattatttatattatttaaaatctatatagaagaaatctaattcttctagacctggatggtagagatatattatgtttaaaaagatatcttttgtatagtattaccagatggcccgcctgaccgtgtggcccgtccgaccgttgattacgttaatccaggctcgagtaggtagaatatctccttcctcctacagtttaactattctataattttctgaatacctctctagttcctgttttctagcatcatcaagcattaatataagcttcgtttctagttgttcaaccagccatattgcttcgtttgattctacggacctcgtgtctctcagtacagagtttcttttggactcgcaagttttataggacagcacagagcagcacattccgacggatgtcttatctccgaggaaatccccgagtctttaatttccgacctgctggggatgtcttcatcttgtattaaaggctgtccagagagcaggggtcaaactgctattttgaccaggaattaagcatcacactaagatattccaatctgtccaatgacggtctctcaggaatcccgaccgctgcaggtcctcatcgtcggtgccggcattgcggggttgacggctgccattgctttgggccagcagggccatcacgttgtggtacgtcaactgcttctatagaaacatcgaccccgaaaagatatactgaggactacagattatcgagaaatccaagttttcccgcgagacgggcgcagccatccatgtgcctcccaattgcaccgctctgctgaattggctgggcattgaccccaagaactttggtggcactttgttggagcaggtatacctagcactccttgatatatgcgcaggtgctaaacttacagattcatcgatatgaccatgtcggcaacttgaagtacctgaaagacttttccgagatccggcagaaatggcaggcagtatggcccccatacaaatttggagagacgaatcacactaacaacccaggaatggtatctggtccaccgagtcgacctacacaactacctcaagcagcgcgccatccagacagccacacttcacatgggctgcaacatcgtcaatattgatctcgatggccagcgcccatctgtcacactcgacaacggcaaccgacatgaagcggatctgctcctcggagctgacggtctgcacgtatgtactactccttgctgctgacgataaaatgtctactcaccgtatatagtctgtcgtccgggaggtgatcggacagacaccccctcctcccttcccggctggcaagtcgtgtttcagatggcttctgccgacggagaagttgcgccatctccctgccacccagaatatcgtgcgcgatcccggggtgttcatcgaatgggccggcggagatcgccgactcgtggcttatccctgctctgacaacacgatgttcaatctttgtgcattccttcccactgccgaagctggtgatgccgccgaaggtatttcccgcccccctaaccgtgtcgcttgaatttgtccataacaattatcgcaggctggcaagcggtcggcaacaagagtgctctcgttgatggattctccgaattcagtccggaagtcaaggagcttgtccacggagcggacgagaatctcaaggtctgggagctgttcgatatgaagtctctcccatcgtgggttaggggatgctccgctttactgggtgatgcagcacatcctttccagccctgtgagttcctcactccaccactgtcggcacataacctaacgatagcagacatgggtcaaggaggcgccatggccattgaagatgcggtttccctagcggtgttgctcccagctgggactcccgtgaaggacatcccggctcggttggccctgtacgagaaagcgagacggtcgcgtgtcgacttggttctggagtacacacgcattaatggagtagatgagattgatacaactgccaagcgcattactggtgaggttatcgccgcttgttgacgaacgcaaactgacgactgtagctgccgagatggtcaaattcatgggcatctgcttttcgcataacgaggtccaaagctccggggcgctacttgcttctcaatagaacaattgccgaatgggttgtttgcgtgctggttctgcgtcacagcctgcgaccgcagactgtatttgccatctgtcttgtagagattagacggggtttagaaataaagaaatataggagtagaatcatagtactagacatatcacccagttgtatatattttcctttcgtctgcttttaaatgttactggctaaactcatagtagaactgaaatagtctcattggtggtatactaagcaattgtcctctggactcatcgtgttactactggtactccacaacggggatcaatagctttgctcccgcagatatatattcggggctactagagaatgtaccctcgcccataattgtacgccaagaacaccaaaacttgacgtgaaaaacatcccctaagactcaagcgtgcatatgtaccgcatccagtttgtagctgaagaagtggttgcgagaaacatcatgctgaagatcgtcggatgcgccaagcacttcgccaaaaattttcgcgccttatccaagacaatctccagcgagagccactctccaccattccccttctgacgttcagatatactaggttggttatcaaaaccataaaagcacactctctactcaataccatagatactgcaaggccccctaagcaacatcagacagccatccctgcaacaatggcgacagactccgagcccctccgcttcgccgatgtaagcccaaccacagcacaacatacccactttcaactgacaagtaaccaggtagcggtaacctacacggcggaccaattccaaggcatctaccgcggcaaacaataccatgccccggacttcggagaagtaatccagcgggccaaagcctacaactgcgagaaaatgatgttgacgaccatgaacctggagggtttccatcgcaacctgcaacttgtccgcgagcatccagaaacatgcaccctcacactaggcgtgcatccttaccacgcgggggagatatacgcctctaccaacgaaccatcctatctctcccagatccgcgagataggccaatccctcctgcgcgaggagaactccccgctcgtagcattcggcgagatcggtctggactacgagtacctcgaccgcgcggacaaggagacgcagatccgcgcattcaaggatcaactcgagctcgcagtggagttccagctcccgctgttcctgcatgttcgggaatcctgtgccgatttcatcgagatcatccgtccgtatctaccccggttacccaagggcgggctagttcattccttcactggctctgtgagcgagatgcggcaattgaccgatgagctgggactggatgtcagcgtgaacggggtatgtttccggacggaggagcaactggagatggtgaaggcgattcccctggacaagttgcagttggagacggatgcgccgtggtgcgaggtgctgagtgcggatgagaagattgcaccgtttctacagaaggcgagggagatgccgccggttaggaaacacaataagttcattctgggacagatggtgaagaatcgcaatgagagctgttttatggagagggtggcgatggtggttgccggggtgaaggggatttcggtgcaggaggtggcacatgcggcgtggaagaacagtatcggcatgtttgggttgggggtacgacagtagatcagttgcaccagaagagagatgcgtttgtatatagagcaggatgtgtatatacttgaagtcactagacatggaccaccgtatagacccctccagcgtccgtctgtatgcctcccgtatatctctccccgttgactgtaaactccgagccaccctgaacacgaatttccaacaagctaccgcttcgcgaggtgattttagcctccgtcaaaacaccccctgaccactccatatcaactacaaagttccccctggccaccaaaccagacacatgtcccgtcggcacagcggctggcagcgccgggagcaaatgcacaaccttgtagctctgcagcagtatctctgcgatcccagaggtaaacccaaagttcccatcgatttgaaacaccgtatctggaccggagtcggtgttccacaagttcggactgggaaacctttgcagatagatctgcgtatggttccagacctggtcgccgtcaaacagccgggcatacaggttcatcgtccaggtacgcgaccagcccgtgcttccgctgccatgggcgatgcgccagtccaggaacgccttggcggccgtggcgagcgtctcgttaacaagcggggccatctggtcaccggggaagagaccgaagaccggactcatatgtcgatgacctgggtcggattcttcgtagtctagtcgccattctaggatgcgaccagaggagccgatctgtggtggcttgatctttgcgagataggatgcagcggtggtgcagtctgtgttgttgattgccagcacgtcgcaggtttcaatgacagcttggaacagctcatggagcannggagttgtccattgtcggggcaatgtctatgccctcttctttccccgctgtggtcatgtcattcggtacgatgtangaggcttccggggacagcgacggcccagtgctgtaatagccctcgaacgggaagagatagcagtagtagaacctcgcagcactctgcaagagtggccagatgcggttccggagaatggactcatcccgtgaaaatcgataatgctcgatcagattagccgacagccatgctccacccataggccacatcgtccaggttgtgccattatcgacgggggctgcatcgccccagaggtcggtgttgtggtgaaggacatacccgccgttgctgcagtggtacatgctttcggctacatcaagccctcggtcatgcacaacatccagcagatcaatgaacggggaaaaggtatcagcgaggttagtgacctctgccggccagtagttcatttcgagattgatgtcgatggtgaatcgcccaccccaggcgggatcgaagtcctggttccacagcccctgtagattggccggtagggctggtgactcggtggcgcgcgaggaggcgatcaatgagtgccggccaaagtggaacatgaggacgaccagctccgggtcgctgtcaggatcaatgcgatagttcaccaagcggctgtcggtgggcaggttgccggctgaaccagaggatcccaggttcaggtccactcgctgcgccaaagcggagtaatcggcgatcgcatttttcttgacggcgacaaagccagagctgcaagcagtgtcaagctttgatttaatctctgcttcccagttttcttgagctgaatagcgataggacgtttcggtgtcgatgaagatgtcgattgtcgaagcgttccggactacgagggatgtgccattgcttgtagcccgccctatcaaagtcagcgtgtcaggtacagattagatcgctctactacggaccatcagaaaccaccctggcctcggccgtaaactgaatggggttcgaaacgttattcgagtaagccctgagcgtcaacaaccccccgtcatgcgagagggttgcattattggacacaacatatcgatctcgaaccaacgaagaagccacattcaagcctccgggctcgctcgacgacaagcgcacagcgactacgttatccggatgactcgccagatactctcgcctatctttatcagccaatatccgcttgaacacaccagagaaacatacctataccgcacagctcgataagtatattccaccaccgccataccactccttaaatccagatatcgcgtataattactgattcccgcctcgtcatgcccaaaatccaggaccaaagaccccagcgcactgtaggactgcggcgaatccgggatgccaaccatatttgctagagtagcatcattcccctccgtcatgttcccctctgccaggagcgaccggactggccaaagggcgtcatacgagcggggattgacacggttgatgaacgggccactccagatggaattctcattgagggtgacattctcggtcgcagtaccccagatggcggcgcctagtctgccattaccaatggggagggtggaggtgaagttgttggccggggtagtgtaccaggagacgtgggaggcgtcgaagttggcgagagccagaggaatggccgctactaaggcgttgtaaagcaggcgtcgcatcatgagcaaagtatcggtggaggtgagaaggacatcattgacgggtaggagatgaagagtatatagattagccgtgcaattatccggaagtggggatgcctgaacattgaagcaatcacgatgcatgaggatacagagaaatggtgcaacggaatgacagggattgacgggattccacaaatcggagacataagaaacggcgaagacgcgccctgatcggcagcacaattaacaatctgactgcagcatgatccttttaacccaccccaaatttatccggctgtttcctggctgcaccatccatgggatgcaaacctggatcagcctgcgaagcaatatctgcaaatgacgagactcggctctgaattgacaccagtgtcgctcaaaggaggaaaccacgacaaggtggaacgctttcatatgataacttttgtttacattgtgtttgttaattacatgatcggtaaggccagaacaagaatcccaatttccacgtcaggcaccttcctcctccacaaggcctgaaggaacatccagaccatatgcggcgttgtctgcctgtccctccggacggtgctgggttttctcgcgtgtgtcgacccccaaccacaacagatccggacggctataatggccacaggcatccacaaagtgccggcacgtcaatatcatatccagatccagatctgcatagacgaatccttcttcattagcgggcaatggctccgtcagccggcgcccatcgggagcgatgacggcggacgcgcctcctcccagggtatcccacggcggagacaagttcatcttctttacgcatgtgggacccagcacggcggtcgtgagcaggacgaacgacgccgactcaagcgcatatacctggctcgcacccgttccacctgaggcccatgtcagctctccgcggtagatcttgcgcgtcttgaatggggtcttaccttcctgtgacatgccccagagtgactcgccccccatatgaggatgcagaacaggccaggccgagacatgaatttcctccccttggatcatggtgtgatatttgagcagcggctggatatgttcccagcacgcgagcgcacccactttaccaatgggcagatcgactacatttaggagactccgcccggaagattctccaaacacggtgcgttccatgtgagtgggtttcatcttgcgccggcgcatcacaatcttgcccgtggagtcgatggtgcactggccgatgtagagggagttgccatcacgctcggaaaggccgaggacaactgtgatcttgtgctgggcagcggcattgcagatgcgacgcatgtgctccgagtcatatgacaaggaattcttgaggtaggtggtgaataggcccatgtcgacggggcgacacctgcccaatggtcagtacacggtcgcggactggcgagggggatgaagccatgctgaccagatccatgctggataccccgggagccaacattcggggaaagtaatcagctgggcgccattgccggccgcctcggcgatcaatcggcaggttttatcgacggtggcgtgcagatccagccagacgggctcgtgctgggtcacggcgacacgaaccttggtggaagctgtcatggttgctaataaagaggtctgtgcgttgtgtttggtgagaagattgattttgagtgaactgttcaagtcaagcgtgagaacaccagatctttatatgatgctgagtgtcatgcgaacaaggctgaagtgatgaatggccaaatagaggtcaaagcgagaagctgaaagggactcgggcagcagaatacgatcagaagtgtgtgtctacgcgagattggaccatgctggtgagaaagttgaggctcgctataggccctgggaaagagcgactactactactactagccatctacatggtcgtggagatgaagatagggggtggtctattcacttacttagtattcggttggaaaccaccccatccgagagattccgattggcccgatcgcgaagagcagtgaagtcgaggcaatgaagatggatggggatgcggcgcagctgctttttaggggatggggtccgtcgtagtgggaggagtggatcatctgaatctgacactctatccacttcgctaatagccccccctgggaatgaaacattgtgtccaataacactgctctctcctgatcgagataggaccagtacggtcgggggtacatgtcatggtcgtggtttacagtagaggctacgggtcttccagggcgaagtctcgccctcactacctaacatgtgaataccttaggctaactagcaggaattaaagatgactgcgagaatacttacgaccactctggcatattatttttagtgaggaagaagaatggatccatttgagggacggaagatagagccacgcacctcgtggccaatcaggtcacgggacccaacgggattcttggccccttccagaatttgaccagaaccgaacccaagggatggccaggatgcctcctacttctcctcggccaagtacatgcctcactccctgaccgcgctagaactttcgatggctgaaaacagaactgcccgtgtaacggatactacctttccataatagcatcattcgagatctagccagactatggtctcatctgacgacgtcagacagttgaagcggtgagatgtggcttcctagcaagcctaccagcctaacctccgcgggatctggacgtacaacaacagagatgtcttaaaaggaggcgtactgaacggctacttactggcatgaaatgcccgagggggatgagatgtggcagggtactgggcaaacgggttgaactttattaataacccgggagattgaacggtacctaaattcactcatactacagtgcgtgcgtctgttgctaagtatttagacatcagctcgcgggctaagaggtcgcagagaggcaccccggacactggagcgtgattttcatgggactcttgccagaatgttggctgtgctacgtaagatatgcgagatgtactgcagcccacagctacctacatacatgcgggctttttgtctctgctcctgaagcagtgatcgagcggcctggacctggccatgatgaggatgttgggccatggcaccatcttcaccttgtcaggtctggtattcccggtttttgtgggagtatccatgtgctgctaaccgaagtcaacttggccaactcacagttgcctacgacgctcctccccatgctgatcgctcgctaaattcagtgattcacaacttgcccatccggcacgttccaaactagggttactggtaaaaagaagaataagacaaaaaaaaaaaaaaaaataggcttatataggctcacctacgacaggaggtccacccgtagcatttggcattccggtgtgacggattgtgatgcacttgtctggaggtacactcagtggacagagtccgcgcgaggggtggccggctcactggaggccgcgcgcccaagaaaccgggtcatggttggacttgacaaaaggccactggtagatgcaggacgcattctctaataagtgttagtaagtactttgttctgcagcttctgattagtgacaatggccggggaagctgcacgaggctgacataagcggtacgcaaaaaggccgttgctgaaacagcaacagcagcatgaagaacccactgcttatctaccacagcagtcctggaccatcccaatacaatgatgatccacgtctgaggccggttttggaaccatttccctgaatcactgggagagaggtcatccccgccccaccgcgggagatacacactgaggaacacgcggcggcgttccctaagcttttgtatcgcctcaattccgcgctaatctcaacttgttgggaatctgtctatcctgccaaggccgcagtgtcaatgcaggtggctggtctcaatatggaagctcgaaggctgagcggtggcttccagaaccagccgggctcttctggattgtccctggaggtgaatccaacctccaacattgcatcagtcaccgctgcggcatgagctggtgccgaaagccgctccccagaagaccatggcaagtttgcgtgagttttggcactttggacccaaactttgatgagccttattcttgaatcttgcgccatcggcctcccttgcacgaccatcataccgtcgcgcgctcacacctgacccatgtagaccgagagtttcgggacccatccaacatacagggtcttgaatggatatgccgatttcatgtaaacgccacggagccggaccttggtatcaggcctgggtctggggcattccaacctcctcacacgagcaaggaggaccggtggctcggagacccgcgctggcgtcgatataccccagaattgatagcgacaatgagggcttattttcccttccacttcatagcctgcatgctcacgccatgattctcctatgtttgacaaccagctaggcaagcaggattagcccctcgcacaggcaagggattcgcttgtctatacctgcccgaataaccgagcaatcgtgactgcggcagagagagaagccaatggtatgcgcttggatgaccgcttcaacatgggttggcacccagttaatcctgaagcattgcgatggcgagcccgaggcacaacggcgtccgtggaggaaagagtatatgaggggaagctcccgagctagttggacctgctgaaccaaagattccacccaacactcatagtagccttagctcctgcttgtctgcttttcttctacaatgtcaccgtcgctacttatccaagaggctccgggaaatgggtggtacaccggactgggcctggctgagctcctggaacggcaggctatcgttcgcggcacagccatcgccattgaagaaggcccgcgcgaagtcacatacggcgaactgcacgaaaaagcactctttgtcgccgaccaggtcaatagtatccttcatgatgacccttccccagtcggcatcattgtcccgcgcagtttgaatcacgtgttatcgcaggttgctgtgatctattcgggccgagcttgtgttccgttggaccccaagctccccgacgagatgctcaagaacatgctcgaaaatctgggctcaacccttgtcatcacggatattctacaacagcatcgactaccgggcgtcaagcatctggtggttgaccaccgcgtggttcctgaaacctttgatgttaacattgccccaagtcagaatgggccgcagacatgctctcatgtgttccacacctccggtacaaccggcaagccaaaggcagtcgaggcctttgcagaggggatgatcaacctttgcctcgatccagcggacctgattcggaagggacagcgggttggacacggctccaacgtcatctttgatacctcgctggtggagatctggggccccttgctgcgcggagcaaccatggttataatcccccaagagactgtcctcgatccccctgctcttagcgacttcgtcaagcagaaagaactcaatgtgctgcaactcacaacctccctgctcactgtgacggcgtatgcctgtccggatgctttctcgaccttggacacccttataaccgggggtgaggcgatcaactgccagacaatccaatccatcttcgatgcaggagccccaggccgcatcatcaacggctatggtccgacggaagccagcgtttatgttttgtaccacgaagtctcggaggaggaggcccgcaggggcgaaatcccagtgggaaagccgttcggcgacgtggaggtattcctcgttgatgataacttgaacacggtcaagccgggcgaggtcggcgagctactggtctctggcgtgggtgtcgctggggggtatattggggatcctgaaaagacggcaaagagcttcgtggtccttccccaactgcagcggaaggtggagcgcggacccaaccacatctatcgaaccggtgacttgatgcgtgtggatgagaaaggagtatattactacctcggccggaaggataaccagatcaagatccgtggtcagcgcgtggagctggaggccttggaatcggccctggttggtacgggcctggtgagcgcggctgtggtggtcaagatcacgccggaagaggtcggccgtggccagtttctgctggcctactgcattccttcctccccagatgtcgccaatggtgccattatgaaagcctacatggagcaggcaccacatctcatggtcccccgtctggagctaattgacatcctcccccttcgctccaccggcaaagttgaccggagggccctggaagaacagtattaccagaagctcaagcgatcacgggctaatggagctaatggaaatttcaacacgggcagtaacgccgctaaactggagtacatctggattgacgtgtttggtctcactgttgagcatctgcgcccaaccgacgacttcgtggctatgggtggaacgtccttgattgctgccacgatgatcgctcgcattaaccaaacctttgggatctcattgcgggctcagatgctctacgaaaacaccagcttcgagagcctgacacggctcgtcaccaacatccaagttcatggcgatgactcgagcattcaggccgaacaggaggtctggctacaagactccaggttgggcgagaacctacggcctatcggaggcgttatcccgcactggcaggacaaacacgaaggcagaattttcctgacgggagcaacaggctttgtgggcgtgtttctcctcgccaccctcgtgaagcggcctgatgtcaagaaggtggcctgtttggtacgcgcccacgatgagccctcagcccgggcacgtctagagaagactatggagaagtatagtctctacgcaaacatggacaaggtcatcgccctgccaggcaattttggacagccccggttgggtctgtctccggagcagtatgactactttgccacatggtctagtgtgatcttccatctcggagccaaggtcagctacgtggctccttattcctcccaccgccaggagaatacgatcgggaccttgaacatgctcgagtttgccactcatcggcggaccaaagccatgcactactcgtccaccatcgcggcctacggtccaactgggtatgttacaggcgccaagctacta
